US011484581B2

(12) United States Patent
Johnston et al.

(10) Patent No.: US 11,484,581 B2
(45) Date of Patent: Nov. 1, 2022

(54) METHOD TO CREATE PERSONALIZED CANINE CANCER VACCINES

(71) Applicant: ARIZONA BOARD OF REGENTS ON BEHALF OF ARIZONA STATE UNIVERSITY, Scottsdale, AZ (US)

(72) Inventors: Stephen Albert Johnston, Tempe, AZ (US); Luhui Shen, Tempe, AZ (US)

(73) Assignee: Arizona Board of Regents on Behalf of Arizona State University, Scottsdale, AZ (US)

( * ) Notice: Subject to any disclaimer, the term of this patent is extended or adjusted under 35 U.S.C. 154(b) by 57 days.

(21) Appl. No.: 16/617,889

(22) PCT Filed: Jun. 1, 2018

(86) PCT No.: PCT/US2018/035744
§ 371 (c)(1),
(2) Date: Nov. 27, 2019

(87) PCT Pub. No.: WO2018/223094
PCT Pub. Date: Dec. 6, 2018

(65) Prior Publication Data
US 2021/0196805 A1    Jul. 1, 2021

Related U.S. Application Data

(60) Provisional application No. 62/514,689, filed on Jun. 2, 2017, provisional application No. 62/514,679, filed on Jun. 2, 2017.

(51) Int. Cl.
| A61K 39/00 | (2006.01) |
| A61P 35/00 | (2006.01) |
| A61K 9/00 | (2006.01) |
| G01N 33/50 | (2006.01) |
| G01N 33/574 | (2006.01) |
| A61K 39/39 | (2006.01) |

(52) U.S. Cl.
CPC ........ *A61K 39/0011* (2013.01); *A61K 9/0019* (2013.01); *A61K 39/39* (2013.01); *A61P 35/00* (2018.01); *G01N 33/505* (2013.01); *G01N 33/5011* (2013.01); *G01N 33/574* (2013.01); *A61K 2039/53* (2013.01); *A61K 2039/545* (2013.01); *A61K 2039/552* (2013.01)

(58) Field of Classification Search
CPC .......... C12N 2760/18122; C12N 15/86; C12N 2760/18144; A61K 2039/552; A61K 39/155; A61K 39/0011; A61K 2300/00; A61K 39/39; A61K 2039/70; A61K 2039/53; A61K 45/06; A61P 31/14; A61P 35/00; A61P 37/04; C07K 16/30; C07K 14/4748; C07K 2317/34; G01N 33/5011;
G01N 33/5047; G01N 33/505; G01N 33/54306; G01N 33/574; G01N 33/6878; C12Q 1/6897; C12Q 1/701
See application file for complete search history.

(56) References Cited

U.S. PATENT DOCUMENTS

| 5,601,989 | A | 2/1997 | Cheever et al. |
| 5,840,839 | A | 11/1998 | Wang et al. |
| 5,961,978 | A | 10/1999 | Gaudernack et al. |
| 6,759,046 | B1 | 7/2004 | Gaudernack et al. |
| 6,861,057 | B2 | 3/2005 | Gaudernack et al. |
| 7,078,416 | B2 | 7/2006 | Gaudernack et al. |
| 7,192,927 | B2 | 3/2007 | Gaudernack et al. |
| 7,375,117 | B2 | 5/2008 | Gaudernack et al. |
| 7,794,723 | B2 | 9/2010 | Gaudernack et al. |
| 7,863,244 | B2 | 1/2011 | Gaudernack et al. |
| 8,053,552 | B2 | 11/2011 | Von et al. |
| 8,193,326 | B2 | 6/2012 | Gaudernack et al. |
| 8,614,177 | B2 | 12/2013 | Gaudernack et al. |
| 8,796,414 | B2 | 8/2014 | Johnston |
| 8,821,864 | B2 | 9/2014 | Knebel-Doeberitz et al. |
| 9,115,402 | B2 | 8/2015 | Hacohen et al. |
| 9,205,140 | B2 * | 12/2015 | Kloor ................. A61K 39/0011 |
| 9,254,311 | B2 | 2/2016 | Bancel et al. |
| 9,265,816 | B2 | 2/2016 | Scheinberg et al. |
| 9,284,349 | B2 | 3/2016 | Tsunoda et al. |
| 9,340,830 | B2 | 5/2016 | Lipson et al. |
| 9,732,131 | B2 | 8/2017 | Johnston |
| 2002/0052308 | A1 | 5/2002 | Rosen et al. |
| 2004/0265803 | A1 | 12/2004 | Doeberitz |
| 2005/0239070 | A1 | 10/2005 | Von et al. |
| 2005/0244421 | A1 | 11/2005 | Strittmatter et al. |
| 2006/0194731 | A1 | 8/2006 | Gaudernack et al. |

(Continued)

FOREIGN PATENT DOCUMENTS

| AU | 2007220042 A1 | 9/2007 |
| CA | 2486738 A1 | 12/2003 |

(Continued)

OTHER PUBLICATIONS

Schiffman et al. Philos Trans R Soc Lond B Biol Sci. Jul. 19, 2015; 370 (1673) , p. 1-13.*
Vannelli et al., "Development of an autologous canine cancer vaccine system for resectable malignant tumors in dogs", Veterinary Immunology and Immunopathology, vol. 182, Dec. 31, 2016 (Dec. 31, 2016), pp. 95-100, XP029810135.
Zhang et al., "Frameshift Antigens for Cancer Vaccine Development", May 31, 2018 (May 31, 2018), XP055767123, Retrieved from the Internet: URL:https://core.ac.uk/download/pdf/157755541. pdf [retrieved on Jan. 20, 2021] * the whole document*.

(Continued)

*Primary Examiner* — Bao Q Li
(74) *Attorney, Agent, or Firm* — Knobbe, Martens, Olson & Bear, LLP

(57) ABSTRACT

Provided herein, are methods of treating cancer in dogs using personalized cancer vaccines comprising peptides having frameshift mutations caused by errors in transcription and splicing of an mRNA.

18 Claims, 17 Drawing Sheets

Specification includes a Sequence Listing.

(56) References Cited

U.S. PATENT DOCUMENTS

| | | | |
|---|---|---|---|
| 2008/0207483 | A1 | 8/2008 | Volinia |
| 2009/0186042 | A1 | 7/2009 | Johnston et al. |
| 2010/0111993 | A1 | 5/2010 | Tuereci et al. |
| 2011/0105721 | A1 | 5/2011 | Gaudernack et al. |
| 2012/0269858 | A1 | 10/2012 | Gaudernack et al. |
| 2013/0072660 | A1 | 3/2013 | Johnston et al. |
| 2013/0129760 | A1 | 5/2013 | Gaudernack et al. |
| 2013/0236490 | A1 | 9/2013 | Kalyanasundaram |
| 2013/0273002 | A1 | 10/2013 | Tuohy |
| 2014/0087963 | A1 | 3/2014 | Johnston et al. |
| 2014/0113286 | A1 | 4/2014 | Chan et al. |
| 2014/0170178 | A1 | 6/2014 | Kloor et al. |
| 2015/0079119 | A1 | 3/2015 | Johnston et al. |
| 2015/0241420 | A1* | 8/2015 | Johnston ............ G01N 33/6845 506/9 |
| 2016/0038579 | A1 | 2/2016 | Kloor et al. |
| 2016/0051654 | A1 | 2/2016 | Singh et al. |
| 2016/0051657 | A1 | 2/2016 | Varga et al. |
| 2016/0069895 | A1 | 3/2016 | Delamarre et al. |
| 2016/0101170 | A1 | 4/2016 | Hacohen et al. |
| 2017/0334963 | A1 | 11/2017 | Johnston |

FOREIGN PATENT DOCUMENTS

| | | | |
|---|---|---|---|
| CA | 2651796 | A1 | 9/2007 |
| EP | 1354895 | A1 | 10/2003 |
| EP | 1369126 | A1 | 12/2003 |
| EP | 1994181 | A2 | 11/2008 |
| EP | 2572725 | A1 | 3/2013 |
| JP | 2009532664 | A | 9/2009 |
| WO | WO-9532731 | A2 | 12/1995 |
| WO | WO-9958552 | A2 | 11/1999 |
| WO | WO-02051994 | A2 | 7/2002 |
| WO | WO-03084467 | A2 | 10/2003 |
| WO | WO-2004111075 | A2 | 12/2004 |
| WO | WO-2005076009 | A2 | 8/2005 |
| WO | WO-2005076099 | A1 | 8/2005 |
| WO | WO 2007/101227 | A2 | 9/2007 |
| WO | WO-2007101227 | A2 | 9/2007 |
| WO | WO-2010037395 | A2 | 4/2010 |
| WO | WO 2014/154905 | A1 | 10/2014 |
| WO | WO-2015103037 | A2 | 7/2015 |
| WO | WO-2015171747 | A1 | 11/2015 |
| WO | WO-2018222917 | A1 | 12/2018 |
| WO | WO-2018223092 | A1 | 12/2018 |
| WO | WO-2018223093 | A1 | 12/2018 |
| WO | WO-2018223094 | A1 | 12/2018 |

OTHER PUBLICATIONS

Extended Search Report issued in EP application No. EP 18810474, dated Jan. 21, 2021.
Yannelli et al., "Development of an autologous canine cancer vaccine system for resectable malignant tumors in dogs", Veterinary Immunology and Immunopathology, vol. 182, Dec. 31, 2016 (Dec. 31, 2016), pp. 95-100, XP029810135.
Bellone et al., Relevance of the Tumor Antigen in the Validation of Three Vaccination Strategies for Melanoma. J Immunol , 165 (5), 2651-6 (2000).
Berzofsky, J., et al. Progress on new vaccine strategies for the immunotherapy and prevention of cancer. J. Clin. Invest. 113(11):1515-1525 (Jun. 2004).
Cancer Facts and Figures 2016 Special Section: Cancer in Asian Americans, Native Hawaiians, and Pacific Islanders. American Cancer Society pp. 1-72.
Chan, TA et al. 5-day dosing schedule of temozolomide in relapsed sensitive or refractory small cell lung cancer (SCLC) and methyl-guanine-DNA methyltransferase (MGMT) analysis in a phase II trial. Journal of Clinical Oncology, 2012 ASCO Annual Meeting Abstracts. 30(15 Suppl) (May 20, 2012) Abstract No. 7052.
Chan, TA et al. Phase II Trial of Temozolomide in Patients with Relapsed Sensitive or Refractory Small Cell Lung Cancer, with Assessment of Methyl-guanine-DNA Methyltransferase as a Potential Biomarker. Clinical Cancer Research, 18(4):1138-1145 (Feb. 15, 2012).
Chang et al., Identifying recurrent mutations in cancer reveals widespread lineage diversity and mutational specificity. Nature Biotechnology 34(2): 155-163 (2016).
Chen, W. et al. Modification of Cysteine Residues In Vitro and In Vivo Affects the Immunogenicity and Antigenicity of Major Histocompatibility Complex Class I restricted Viral Determinants. The Journal of Experimental Medicine, 189(11):1757-1764 (Jun. 7, 1999).
Combination Vaccines and Multiple Vaccinations—Vaccine Knowledge Project University of Oxford. (http://vk.ovg.ox.ac.uk/combination-vaccines-and-multiple-vaccinations) Website Accessed Oct. 4, 2013.
Co-pending U.S. Appl. No. 16/617,805, filed Nov. 27, 2019.
Co-pending U.S. Appl. No. 16/617,830, filed Nov. 27, 2019.
Disis et al., HER-2/neu Oncogenic Protein: Issues in Vaccine Development. Critical Reviews in Immunology. 18(1-2): 37-45 (1998).
Donnelly et al., Technical and Regulatory Hurdles for DNA Vaccines. Int J Parasitol , 33 (5-6), 457-67 (2003).
Emens et al., Toward a Breast Cancer Vaccine: Work in Progress. Oncology (Williston Park) , 17 (9), 1200-11; discussion 1214, 1217-8 (2003).
Englehard, VH, Structure of peptides associated with class I and class II MHC molecules. Annu Rev Immunol. 12:181-207 (1994).
European Application No. 07757589 Supplementary Search Report dated Apr. 20, 2010.
Fidler, Selection of Successive Tumor Lines for Metastasis. Nature New Biology 242:148-149 (1973).
Finn, Cancer Vaccines: Between the Idea and the Reality. Nat Rev Immunol , 3 (8), 630-41 (2003).
Finn, Premalignant Lesions as Targets for Cancer Vaccines. J Exp Med 198 (11): 1623-1626 (2003).
Gite, S. et al. A high-throughput nonisotopic protein truncation test. Nature Biotechnology, 21(2):194-197 (2003) [Abstract Only].
Guo, C. et al. Past, Present and Future. Advances in Cancer Research, 119:421-475 (2013).
Hellmann, M. et al. Genomic profile, smoking, and response to anti-PD-1 therapy in non-small cell lung carcinoma, Molecular & Cellular Oncology, 3(1):e1048929 (3 pages) (2016).
International Application No. PCT/US18/35741 International Search Report and Written Opinion dated Sep. 7, 2018.
International Application No. PCT/US18/35744, International Search Report and Written Opinion dated Aug. 31, 2018.
International Application No. PCT/US2007/062920 International Search Report and Written Opinion dated May 16, 2008.
Jaffe, Vax Facts. The Scientist (2004).
"Kerr, C. Huntington's disease provides cancer clues. The Lancet, Oncology, 3(9):518 (2002)".
Kirovski, D. et al. Combinatorics of the Vaccine Design Problem: Definition and an Algorithm. Technical Report MSR-TR-2007-148. Microsoft Research (http://research.microsoft.com) (Nov. 2007).
Kloor, M. et al. The Immune Biology of Microsatellite-Unstable Cancer. CellPress Trends in Cancer 2(3):121-133 (Mar. 2016).
Konig, Interactions Between MHC Molecules and Co-Receptors of the TCR. Curr Opin Immunol , 14 (1), 75-83 (2002).
Korber, B. et al. Immunoinformatics Comes of Age. PLoS Computation Biology, 2(6):e71(9pages) (Jun. 2006).
Krieg, CpG Motifs: The Active Ingredient in Bacterial Extracts? Nat Med , 9 (7), 831-5 (2003).
Leaf, C. Why we're losing the war on cancer. Fortune, 149(6):76-82 (2004).
Lee, HoJoon. Identification of Neo-antigens for a Cancer Vaccine by Transcriptome Analysis. A Dissertation Presented in Partial Fulfillment of the Requirements for the Degree Doctor of Philosophy, Arizona State University. p. 1-168 (May 2012).
Lennerz et al. The response of autologous T cells to a human melanoma is dominated by mutated neoantigens. PNAS USA 102(44):16013-16018 (2005).
Lewis, J. Therapeutic cancer vaccines: using unique antigens. PNAS: 101 Supplement 2:14653-14656 (2004).

(56) References Cited

OTHER PUBLICATIONS

Leyssen et al., Prospects for Antiviral Therapy. Adv Virus Res , 61, 511-53 (2003).
Lin, Hong Huang et al. Evaluation of MHC class I peptide binding prediction servers: Application for vaccine research. BMC Immunology 9(8):1-13 (Mar. 16, 2008).
Lindahl, DNA Repair. DNA Surveillance Defect in Cancer Cells. Curr Biol , 4 (3), 249-51 (1994).
Linnebacher, M. et al. Frameshift Peptide-Derived T-Cell Epitopes: A Source of Novel Tumor-Specific Antigens, International Journal of Cancer, 93; 6-11 (2001).
Minev, Melanoma Vaccines. Semin Oncol , 29 (5), 479-93 (2002).
Nestle et al., Vaccines and melanoma. Clinical and Experimental Dermatology 27: 597-601 (2002).
No Author, Misguided cancer goal. Nature 491: 637 (2012).
Pawlik et al., Malignant Melanoma: Current State of Primary and Adjuvant Treatment. Crit Rev Oncol Hematol, 45 (3), 245-64 (2003).
PCT/US2018/03573 International Preliminary Report on Patentability dated Dec. 3, 2019.
PCT/US2018/035741 International Preliminary Report on Patentability dated Dec. 3, 2019.
PCT/US2018/035744 International Preliminary Report on Patentability dated Dec. 3, 2019.
Rammensee, H.G. et al. Peptides naturally presented by MHC class I molecules, Annu. Rev. Immunol. 11:213-244 (1993).
Rammensee et al., Towards patient-specific tumor antigen selection for vaccination. Immunological Reviews. 188:164-176 (2002).
Rappuoli, Rino et al. New Approaches to Vaccine Design, from Vaccine Design Innovative Approaches and Novel Strategies Eds: Rino Rappuoli and Fabio Bagnoli (2011) Caister Academic Press.
Renno et al., What's new in the field of cancer vaccines? Cellular and Molecular Life Sciences CMLS 60(7): 1296-1310 (2003).
Saeterdal et al., Frameshift-mutation-derived Peptides as Tumor-Specific Antigens in Inherited and Spontaneous Colorectal Cancer. Proc Natl Acad Sci U S A , 98 (23), 13255-60 (2001).
Saeterdal, I., et al. Frameshift-mutation-derived peptides as tumor-specific antigens in inherited and spontaneous colorectal cancer. PNAS 98(23):13255-13260 (2001).
Schultze JL et al. From cancer genomics to cancer immunotherapy: toward second-generation tumor antigens. Trends Immunol. 22(9):516-23 (Sep. 1, 2001).
Sette et al. The relationship between class I binding affinity and immunogenicity of potential cytotoxic T cell epitopes. J Immunol 153:5586-5592 (1994).
Shen, Luhui. Investigation of Tumor Frame Shift Antigens for Prophylactic Cancer Vaccine, Cancer Detection and Tumorigenicity. A Thesis Presented in Partial Fulfillment of the Requirements for the Degree of Doctor of Philosophy. Arizona State University. pp. 1-256 (Dec. 2012).
Snyder, Alexandra et al. Genetics and Immunology: reinvigorated, OncoImmunology, 4(10);e1029705 (2 pages) Oct. 2015.
Sorensen, S.A., et al. Significantly lower incidence of cancer among patients with Huntington disease. Cancer, 86(7):355-359 (1999) [Abstract Only].
Sussman, Personalized Cancer Vaccine Promises Remission. Drug Discov Today , 8 (15), 657-8 (2003).
Sykes et al., Genetic Live Vaccines Mimic the Antigenicity but not Pathogenicity of Live Viruses. DNA and Cell Biology 18(7): 521-531 (1999).
Sykes, K.F. et al., Linear expression elements: a rapid, in vivo, method to screen for gene functions. Nat. Biotechnology, 17(4):355-359 (1999).
Tang et al., Genetic Immunization Is a Simple Method for Eliciting an Immune Response. Nature , 356 (6365), 152-4 (1992).
Timares et al., Quantitative analysis of the immunopotency of genetically transfected dendritic cells. PNAS 95(22): 13147-13152 (1998).
U.S. Appl. No. 14/451,374 Final Office Action dated Dec. 27, 2016.
U.S. Appl. No. 15/669,666 Final Office Action dated Jan. 24, 2020.
U.S. Appl. No. 15/669,666 Office Action dated Sep. 30, 2019.
Usmani, Genomic Instability and Metastatic Progression. Pathobiology 61: 109-116 (1993).
Vogelstein, et al. Cancer genome landscapes. Science. Mar. 29, 2013;339(6127):1546-58. doi: 10.1126/science.1235122.
Wang, R. et al. Utilization of an alternative open reading frame of a normal gene in generation a novel human cancer antigen. The Journal of Experimental Medicine 183:1131-1140 (1996).
Weinschenk, Toni et al. Integrated Functional Genomics Approach for the Design of Patient-Individual Antitumor Vaccines, Cancer Research 62(20):5818-5827 (2002).
Woerner, SM et al. Systematic Identification of Genes with Coding Microsatellites Mutated in DNA Mismatch Repair-Deficient Cancer Cells, International Journal of Cancer, 93(1); 12-19 (2001).
Wolchok et al., Phase I Trial of High Dose Paracetamol and Carmustine in Patients With Metastatic Melanoma. Melanoma Res, 13 (2), 189-96 (2003).

* cited by examiner

Sec62 XM_846664.4 (11A)
WT: AAA GAA AAA AAA AAA GAT GGG GAA AAG GAA GAG CCT AAA
    K    E    K    K    K    D    G    E    K    E    E    P    K
                                1A Insertion 1A Ins: AAA GAA AAA AAA AAA AGA TGG GGA AAA GGA AGA GCC TAA
       K    E    K    K    K    <u>R    W    G    K    G    R    A    *</u>
                      1A Deletion
                          Insertion Frameshift Sequence 1A Del: AAA GAA AAA AAA AAG ATG GGA AAA AGG AAG AGC CTA AAA
      K    E    K    K    K    <u>M    G    K    R    K    S    L    K...</u>
                                Deletion Frameshift Sequence

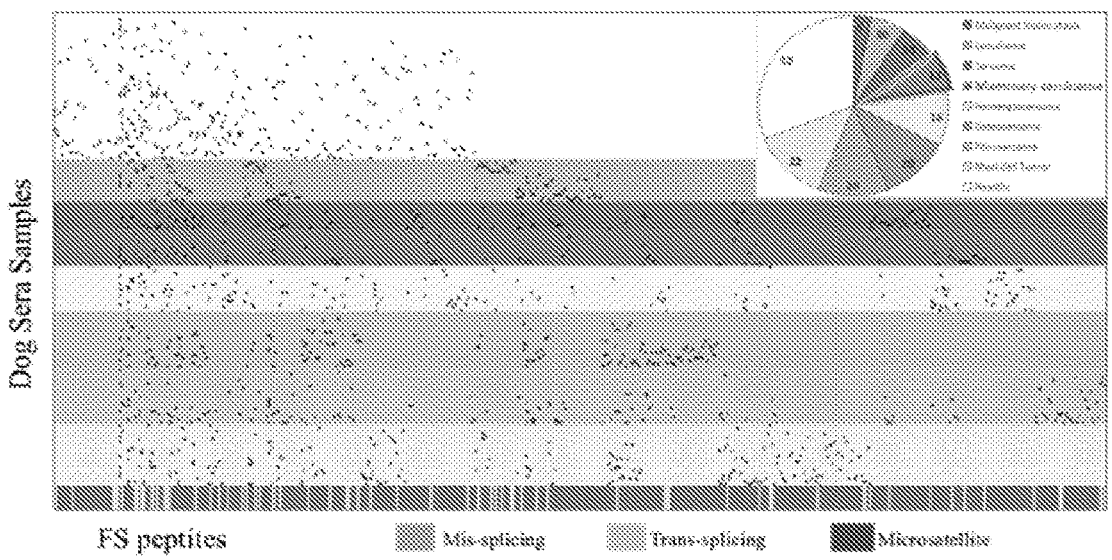
FIG. 9
A
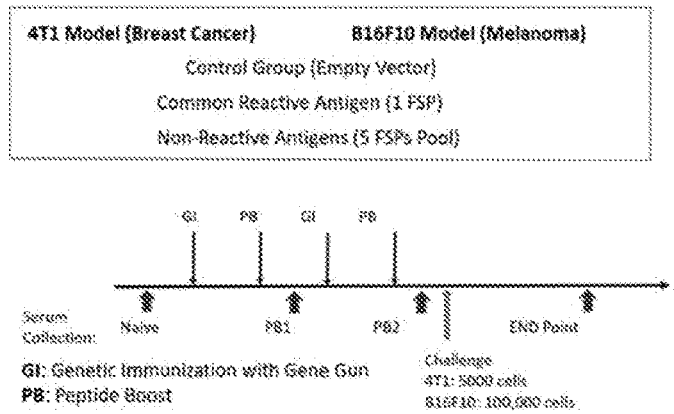
FIG. 10A
B
FIG. 10B

C

D

METHOD TO CREATE PERSONALIZED CANINE CANCER VACCINES

CROSS-REFERENCE

This application is a U.S. National Phase of International Application No. PCT/US2018/035744, filed on Jun. 1, 2018, which claims the benefit of U.S. Provisional Application No. 62/514,689, filed Jun. 2, 2017, and U.S. Provisional Application No. 62/514,679, filed Jun. 2, 2017, each of which are incorporated herein by reference in their entireties.

SEQUENCE LISTING

The instant application contains a Sequence Listing which has been submitted electronically in ASCII format and is hereby incorporated by reference in its entirety. Said ASCII copy, created on Jul. 16, 2018, is named 42206-717_831_SL.txt and is 3,114,193 bytes in size.

BACKGROUND

There is a resurgence of enthusiasm to use the immune system to treat canine cancer. This is most notable with respect to using checkpoint inhibitors (as antibodies) to release the existing immune response in the patient to their own tumor. Yet, only a small proportion of the patients treated have a positive response. The evidence to date is that whether a patient has an effective response to the treatment depends on the nature of the immune response they have established against the tumor. More specifically, the level and quality of the immune response to neopeptides in the cancer seems to be most important. This has led to the concept of personal cancer vaccines to bolster the response of the inhibitors and therefore, to increase the response rate.

SUMMARY

Provided herein are methods of treating an individual in need of treatment for a cancer. Some such methods comprising, a) identifying peptides that are immunoreactive with a biological sample from the individual in a first population of peptides; b) preparing a vaccine composition comprising a second population of peptides comprising one or more peptides identified in step a) or a nucleic acid sequence encoding the second population of peptides; and c) administering an effective amount of the vaccine composition to the individual, thereby treating the cancer. In some cases, the method comprises obtaining the biological sample from the individual. Often, treating the cancer comprises reducing tumor size, inhibiting tumor growth, reducing tumor burden, increasing survival, or increasing cancer-free survival. In some cases, administering the vaccine composition elicits an immune response in the individual against the cancer. Sometimes, the second population of peptides is a subpopulation of the first population. Often, the identified peptide elicits a positive response in an antibody assay or a T cell assay performed on the biological sample from the individual. In some cases, the biological sample is selected from the group consisting of blood, plasma, serum, thymus, bone marrow, spleen, lymph node, bronchoalveolar lavage, breast, central nervous system, cerebrospinal fluid, eye, tears, gastrointestinal tract, saliva, feces, urine, heart, kidney, liver, lung, muscle, pancreas, peripheral nervous system, saliva, skin, thyroid, trachea, and tumor. Often, the biological sample comprises cells selected from B cells, T cells, CD4+ T cells, CD8+ T cells, Th17 cells, and combinations thereof. Alternatively and in combination, the biological sample comprises an antibody. Often, identifying comprises determining immunoreactivity of the first population of peptides to the biological sample using antibody reactivity. In some cases, antibody reactivity is detected using an antibody assay selected from the group consisting of ELISA, radio-immunoassay, western blot, surface plasmon resonance, immunostaining, immunoprecipitation, mass spectrometry, phage display, ELISPOT, flow cytometry, cytometric bead array, immunohistochemistry, high density array, microarray, delayed-type hypersensitivity (DTH), and combinations thereof. Alternately, or in combination, identifying comprises determining immunoreactivity of the first population of peptides to the biological sample using a T cell response. Often, the T cell response is detected using an assay selected from the group consisting of proliferation assay, 3H-thymidine assay, BrdU assay, CFSE assay, cytokine secretion assay, ELISA assay, ELISPOT assay, intracellular staining assay, quantitative rtPCR assay, cytometric bead array assay, cytotoxicity assay, 51-chromium assay, degranulation assay, granulysin assay, granzyme A assay, granzyme B assay, and perforin assay. In some cases, the first population of peptides comprises peptides encoded by a frameshifted mRNA expressed by a cancer cell. Sometimes, a frameshifted mRNA is created in a splicing error or a transcription insertion or deletion error. Often, the first population of peptides comprises peptides having a sequence selected from SEQ ID NO: 1-10665. In some cases, each of the first population of peptides binds to at least one MHC subtype. Sometimes, each of the first population of peptides comprises at least one T cell epitope. In some cases, each of the first population of peptides comprises at least on B cell epitope. Often, the first population of peptides is bound to a substrate. In some cases, the first population of peptides is part of an array or a phage display library. Often, the vaccine composition comprises a pharmaceutically acceptable adjuvant or excipient. Often, the adjuvant is selected from the group consisting of ABM2, AS01B, AS02, AS02A, Adjumer, Adjuvax, Algammulin, Alum, Aluminum phosphate, Aluminum potassium sulfate, *Bordetella pertussis*, Calcitriol, Chitosan, Cholera toxin, CpG, Dibutyl phthalate, Dimethyldioctadecylammonium bromide (DDA), Freund's adjuvant, Freund's complete, Freund's incomplete (IFA), GM-CSF, GMDP, Gamma Inulin, Glycerol, HBSS (Hank's Balanced Salt Solution), IL-12, IL-2, Imiquimod, Interferon-Gamma, ISCOM, Lipid Core Peptide (LCP), Lipofectin, Lipopolysaccharide (LPS), Liposomes, MF59, MLP+ TDM, Monophosphoryl lipid A, Montanide IMS-1313, Montanide ISA 206, Montanide ISA 720, Montanide ISA-51, Montanide ISA-50, nor-MDP, Oil-in-water emulsion, P1005 (non-ionic copolymer), Pam3Cys (lipoprotein), Pertussis toxin, Poloxamer, QS21, RaLPS, Ribi, Saponin, Seppic ISA 720, Soybean Oil, Squalene, Syntex Adjuvant Formulation (SAF), Synthetic polynucleotides (poly IC/poly AU), TiterMax Tomatine, Vaxfectin, XtendIII, and Zymosan. In some cases, the vaccine composition comprises an immune checkpoint inhibitor. Often, the immune checkpoint inhibitor is selected from one or more of the group consisting of a PD-1 inhibitor, a PD-L1 inhibitor, and a CTLA-4 inhibitor. Often, the immune checkpoint inhibitor is selected from one or more of the group consisting of Pembrolizumab, Nivolumab, and Atezolizumab. Sometimes, the vaccine is administered via a route selected from the group consisting of subcutaneous, intradermal, intramuscular, intranasal, intravenous, and sublingual. In some cases, the individual is a mammal. In some cases, the individual is a dog. Often, the cancer is selected from the group consisting of Acute lymphoblastic leukemia, Acute monocytic leukemia, Acute myeloid leukemia, Acute promyelocytic leukemia, Adenocarcinoma, Adult T-cell leukemia, Astrocytoma, Bladder cancer, Bone Cancer, Brain Tumor, Breast Cancer, Burkitt's lymphoma, Carcinoma, Cervical Cancer, Chronic Lymphocytic Leukemia, Chronic myelogenous leukemia, Colon Cancer, Colorectal cancer, Endometrial cancer, Glioblastoma multiforme, Glioma, Hepatocellular carcinoma, Hodgkin's lymphoma, Inflammatory breast cancer, Kidney Cancer, Leukemia, Lung cancer, Lymphoma, Malignant Mesothelioma, Medulloblastoma, Melanoma, Multiple myeloma, Neuroblastoma, Non-Hodgkin Lymphoma, Non-Small Cell Lung Cancer, Ovarian Cancer, Pancreatic Cancer, Pituitary tumor, Prostate cancer, Retinoblastoma, Skin Cancer, Small Cell Lung Cancer, Squamous cell carcinoma, Stomach cancer, T-cell leukemia, T-cell lymphoma, Thyroid cancer, and Wilms' tumor.

Also provided herein are methods of eliciting an immune response in an individual having cancer. Some such methods comprising, a) identifying peptides that are immunoreactive with a biological sample in a first population of peptides; b) preparing a vaccine composition comprising a second population of peptides comprising one or more peptides identified in step a) or a nucleic acid sequence encoding the second population of peptides; and c) administering the vaccine composition to the individual, wherein administering the vaccine composition elicits an immune response in the individual against the cancer. In some cases, the method comprises obtaining the biological sample from the individual. Often, the method comprises treating the cancer. In some cases, treating the cancer comprises reducing tumor size, inhibiting tumor growth, reducing tumor burden, increasing survival, or increasing cancer-free survival. Often, the second population of peptides is a subpopulation of the first population. In some cases, the identified peptide elicits a positive response in an antibody assay or a T cell assay performed on the biological sample from the individual. In some cases, the immune response is a T cell response. Alternately, or in combination, the immune response is an antibody response. Often, the immune response is directed to a cancer. In some cases, the cancer is selected from the group consisting of Acute lymphoblastic leukemia, Acute monocytic leukemia, Acute myeloid leukemia, Acute promyelocytic leukemia, Adenocarcinoma, Adult T-cell leukemia, Astrocytoma, Bladder cancer, Bone Cancer, Brain Tumor, Breast Cancer, Burkitt's lymphoma, Carcinoma, Cervical Cancer, Chronic Lymphocytic Leukemia, Chronic myelogenous leukemia, Colon Cancer, Colorectal cancer, Endometrial cancer, Glioblastoma multiforme, Glioma, Hepatocellular carcinoma, Hodgkin's lymphoma, Inflammatory breast cancer, Kidney Cancer, Leukemia, Lung cancer, Lymphoma, Malignant Mesothelioma, Medulloblastoma, Melanoma, Multiple myeloma, Neuroblastoma, Non-Hodgkin Lymphoma, Non-Small Cell Lung Cancer, Ovarian Cancer, Pancreatic Cancer, Pituitary tumor, Prostate cancer, Retinoblastoma, Skin Cancer, Small Cell Lung Cancer, Squamous cell carcinoma, Stomach cancer, T-cell leukemia, T-cell lymphoma, Thyroid cancer, and Wilms' tumor. Often, the biological sample is selected from the group consisting of blood, plasma, serum, thymus, bone marrow, spleen, lymph node, bronchoalveolar lavage, breast, central nervous system, cerebrospinal fluid, eye, tears, gastrointestinal tract, saliva, feces, urine, heart, kidney, liver, lung, muscle, pancreas, peripheral nervous system, saliva, skin, thyroid, trachea, and tumor. In some cases, the biological sample comprises cells selected from B cells, T cells, CD4+ T cells, CD8+ T cells, Th17 cells, and combinations thereof. Alternately, or in combination, the biological sample comprises an antibody. Often, identifying comprises determining immunoreactivity of the first population of peptides to the biological sample using antibody reactivity. In some cases, antibody reactivity is detected using an antibody assay selected from the group consisting of ELISA, radio-immunoassay, western blot, surface plasmon resonance, immunostaining, immunoprecipitation, mass spectrometry, phage display, flow cytometry, cytometric bead array, immunohistochemistry, high density array, microarray and combinations thereof. In some cases, identifying comprises determining immunoreactivity of the first population of peptides to the biological sample using a T cell response. In some cases, the T cell response is detected using an assay selected from the group consisting of proliferation assay, 3H-thymidine assay, BrdU assay, CFSE assay, cytokine secretion assay, ELISPOT assay, intracellular staining assay, quantitative rtPCR assay, cytometric bead array assay, cytotoxicity assay, 51-chromium assay, degranulation assay, granulysin assay, granzyme A assay, granzyme B assay, and perforin assay. Often, the first population of peptides comprises peptides encoded by a frameshifted mRNA expressed by a cancer cell. In some cases, a frameshifted mRNA is created in a splicing error or a transcription insertion or deletion error in a microsatellite. Often, the first population of peptides comprises peptides having a sequence selected from SEQ ID NO: in 1-10665. In some cases, each of the first population of peptides binds to at least one MHC subtype. Often, each of the first population of peptides comprises at least one T cell epitope. In some cases, each of the first population of peptides comprises at least on B cell epitope. Often, the first population of peptides is bound to a substrate. In some cases, the first population of peptides is part of an array or a phage display library. Often, the vaccine composition comprises a pharmaceutically acceptable adjuvant or excipient. Sometimes, the adjuvant is selected from the group consisting of ABM2, AS01B, AS02, AS02A, Adjumer, Adjuvax, Algammulin, Alum, Aluminum phosphate, Aluminum potassium sulfate, *Bordetella pertussis*, Calcitriol, Chitosan, Cholera toxin, CpG, Dibutyl phthalate, Dimethyldioctadecylammonium bromide (DDA), Freund's adjuvant, Freund's complete, Freund's incomplete (IFA), GM-CSF, GMDP, Gamma Inulin, Glycerol, HBSS (Hank's Balanced Salt Solution), IL-12, IL-2, Imiquimod, Interferon-Gamma, ISCOM, Lipid Core Peptide (LCP), Lipofectin, Lipopolysaccharide (LPS), Liposomes, MF59, MLP+TDM, Monophosphoryl lipid A, Montanide IMS-1313, Montanide ISA 206, Montanide ISA 720, Montanide ISA-51, Montanide ISA-50, nor-MDP, Oil-in-water emulsion, P1005 (non-ionic copolymer), Pam3Cys (lipoprotein), Pertussis toxin, Poloxamer, QS21, RaLPS, Ribi, Saponin, Seppic ISA 720, Soybean Oil, Squalene, Syntex Adjuvant Formulation (SAF), Synthetic polynucleotides (poly IC/poly AU), TiterMax Tomatine, Vaxfectin, XtendIII, and Zymosan. Often, the vaccine composition comprises an immune checkpoint inhibitor. In some cases, the immune checkpoint inhibitor is selected from one or more of the group consisting of a PD-1 inhibitor, a PD-L1 inhibitor, and a CTLA-4 inhibitor. In some cases, the immune checkpoint inhibitor is selected from one or more of the group consisting of Pembrolizumab, Nivolumab, and Atezolizumab. Often, the vaccine is administered via a route selected from the group consisting of subcutaneous, intradermal, intramuscular, intranasal, intravenous, orally, intradermal and sublingual. In some cases, the individual is a mammal. Often, the individual is a dog.

Also provided herein are methods of reducing risk of developing cancer in an individual. Some such methods comprising, a) identifying peptides that are immunoreactive with a biological sample in a first population of peptides; b) preparing a vaccine composition comprising a second population of peptides comprising one or more peptides identified in step a) or a nucleic acid sequence encoding the second population of peptides; and c) administering the vaccine composition to the individual, wherein administering the vaccine composition elicits an immune response in the individual against the cancer and wherein the risk of developing cancer in the individual is reduced compared to an individual who did not receive the vaccine. In some cases, the method comprises obtaining the biological sample from the individual. Often, administering the vaccine composition elicits an immune response in the individual against the cancer. In some cases, the second population of peptides is a subpopulation of the first population. Often, the identified peptide elicits a positive response in an antibody assay or a T cell assay performed on the biological sample from the individual. Sometimes, the biological sample is selected from the group consisting of blood, plasma, serum, thymus, bone marrow, spleen, lymph node, bronchoalveolar lavage, breast, central nervous system, cerebrospinal fluid, eye, tears, gastrointestinal tract, saliva, feces, urine, heart, kidney, liver, lung, muscle, pancreas, peripheral nervous system, saliva, skin, thyroid, trachea, and tumor. Often, the biological sample comprises cells selected from B cells, T cells, CD4+ T cells, CD8+ T cells, Th17 cells, and combinations thereof. In some cases, the biological sample comprises an antibody. Often, identifying comprises determining immunoreactivity of the first population of peptides to the biological sample using antibody reactivity. In some cases, antibody reactivity is detected using an antibody assay selected from the group consisting of ELISA, radio-immuno assay, western blot, surface plasmon resonance, immunostaining, immunoprecipitation, mass spectrometry, phage display, ELISPOT, flow cytometry, cytometric bead array, immunohistochemistry, high density array, microarray, delayed-type hypersensitivity (DTH), and combinations thereof. Often, identifying comprises determining immunoreactivity of the first population of peptides to the biological sample using a T cell response. In some cases, the T cell response detected using an assay selected from the group consisting of proliferation assay, 3H-thymidine assay, BrdU assay, CFSE assay, cytokine secretion assay, ELISA assay, ELISPOT assay, intracellular staining assay, quantitative rtPCR assay, cytometric bead array assay, Cytotoxicity assay, 51-chromium assay, degranulation assay, granulysin assay, granzyme A assay, granzyme B assay, and perforin assay. In some cases, the first population of peptides comprises peptides encoded by a frameshifted mRNA expressed by a cancer cell. Often, a frameshifted mRNA is created in a splicing error or a transcription insertion or deletion error in a microsatellite. In some cases, the first population of peptides comprises peptides having a sequence selected from SEQ ID NO: 1-10665. Often, each of the first population of peptides binds to at least one MHC subtype. In some cases, each of the first population of peptides comprises at least one T cell epitope. Alternately, or in combination, each of the first population of peptides comprises at least on B cell epitope. In some cases, the first population of peptides is bound to a substrate. Often, the first population of peptides is part of an array or a phage display library. Often, the vaccine composition comprises a pharmaceutically acceptable adjuvant or excipient. In some cases, the adjuvant is selected from the group consisting of ABM2, AS01B, AS02, AS02A, Adjumer, Adjuvax, Algammulin, Alum, Aluminum phosphate, Aluminum potassium sulfate, *Bordetella pertussis*, Calcitriol, Chitosan, Cholera toxin, CpG, Dibutyl phthalate, Dimethyldioctadecylammonium bromide (DDA), Freund's adjuvant, Freund's complete, Freund's incomplete (IFA), GM-CSF, GMDP, Gamma Inulin, Glycerol, HBSS (Hank's Balanced Salt Solution), IL-12, IL-2, Imiquimod, Interferon-Gamma, ISCOM, Lipid Core Peptide (LCP), Lipofectin, Lipopolysaccharide (LPS), Liposomes, MF59, MLP+TDM, Monophosphoryl lipid A, Montanide IMS-1313, Montanide ISA 206, Montanide ISA 720, Montanide ISA-51, Montanide ISA-50, nor-MDP, Oil-in-water emulsion, P1005 (non-ionic copolymer), Pam3Cys (lipoprotein), Pertussis toxin, Poloxamer, QS21, RaLPS, Ribi, Saponin, Seppic ISA 720, Soybean Oil, Squalene, Syntex Adjuvant Formulation (SAF), Synthetic polynucleotides (poly IC/poly AU), TiterMax Tomatine, Vaxfectin, XtendIII, and Zymosan. Often, the vaccine composition comprises an immune checkpoint inhibitor. In some cases, the immune checkpoint inhibitor is selected from one or more of the group consisting of a PD-1 inhibitor, a PD-L1 inhibitor, and a CTLA-4 inhibitor. Often, the immune checkpoint inhibitor is selected from one or more of the group consisting of Pembrolizumab, Nivolumab, and Atezolizumab. In some cases, the vaccine is administered via a route selected from the group consisting of subcutaneous, intradermal, intramuscular, intranasal, intravenous, and sublingual. Often, the individual is a mammal. In some cases, the individual is a dog. In some cases, the cancer is selected from the group consisting of Acute lymphoblastic leukemia, Acute monocytic leukemia, Acute myeloid leukemia, Acute promyelocytic leukemia, Adenocarcinoma, Adult T-cell leukemia, Astrocytoma, Bladder cancer, Bone Cancer, Brain Tumor, Breast Cancer, Burkitt's lymphoma, Carcinoma, Cervical Cancer, Chronic Lymphocytic Leukemia, Chronic myelogenous leukemia, Colon Cancer, Colorectal cancer, Endometrial cancer, Glioblastoma multiforme, Glioma, Hepatocellular carcinoma, Hodgkin's lymphoma, Inflammatory breast cancer, Kidney Cancer, Leukemia, Lung cancer, Lymphoma, Malignant Mesothelioma, Medulloblastoma, Melanoma, Multiple myeloma, Neuroblastoma, Non-Hodgkin Lymphoma, Non-Small Cell Lung Cancer, Ovarian Cancer, Pancreatic Cancer, Pituitary tumor, Prostate cancer, Retinoblastoma, Skin Cancer, Small Cell Lung Cancer, Squamous cell carcinoma, Stomach cancer, T-cell leukemia, T-cell lymphoma, Thyroid cancer, and Wilms' tumor.

Also provided herein are methods of designing a personalized vaccine for an individual. Some such methods comprise a) identifying peptides that are immunoreactive with a biological sample in a first population of peptides; b) preparing a vaccine composition comprising a second population of peptides comprising one or more peptides identified in step a) or a nucleic acid sequence encoding the second population of peptides. In some cases, the method comprises obtaining the biological sample from the individual. Often, administration of an effective amount of the vaccine treats the cancer in the individual. In some cases, the cancer comprises reducing tumor size, inhibiting tumor growth, reducing tumor burden, increasing survival, or increasing cancer-free survival. Often, administering the vaccine composition elicits an immune response in the individual against the cancer. Sometimes, the second population of peptides is a subpopulation of the first population. Often, the identified peptide elicits a positive response in an antibody assay or a T cell assay performed on the biological sample from the individual. In some cases, the biological sample is selected from the group consisting of blood, plasma, serum, thymus, bone marrow, spleen, lymph node, bronchoalveolar lavage, breast, central nervous system, cerebrospinal fluid, eye, tears, gastrointestinal tract, saliva, feces, urine, heart, kidney, liver, lung, muscle, pancreas, peripheral nervous system, saliva, skin, thyroid, trachea, and tumor. Often, the biological sample comprises cells selected from B cells, T cells, CD4+ T cells, CD8+ T cells, Th17 cells, and combinations thereof. Alternately or in combination, the biological sample comprises an antibody. Often, identifying comprises determining immunoreactivity of the first population of peptides to the biological sample using antibody reactivity. In some cases, antibody reactivity is detected using an antibody assay selected from the group consisting of ELISA, radio-immuno assay, western blot, surface plasmon resonance, immunostaining, immunoprecipitation, mass spectrometry, phage display, flow cytometry, cytometric bead array, immunohistochemistry, high density array, microarray, and combinations thereof. Often, identifying comprises determining immunoreactivity of the first population of peptides to the biological sample using a T cell response. In some cases, the T cell response is detected using an assay selected from the group consisting of proliferation assay, 3H-thymidine assay, BrdU assay, CFSE assay, cytokine secretion assay, ELISPOT assay, intracellular staining assay, quantitative rtPCR assay, cytometric bead array assay, cytotoxicity assay, 51-chromium assay, degranulation assay, granulysin assay, granzyme A assay, granzyme B assay, and perforin assay. In some cases, the first population of peptides comprises peptides encoded by a frameshifted mRNA expressed by a cancer cell. Often, a frameshifted mRNA is created in by a transcription insertion or deletion error in a microsatellite in a coding region. In some cases, the first population of peptides comprises peptides having a sequence selected from SEQ ID NO: 1-10665. In some cases, each of the first population of peptides binds to at least one MHC subtype. Often, each of the first population of peptides comprises at least one T cell epitope. In some cases, each of the first population of peptides comprises at least on B cell epitope. In some cases, the first population of peptides is bound to a substrate. Often, the first population of peptides is part of an array or a phage display library. In some cases, the vaccine composition comprises a pharmaceutically acceptable adjuvant or excipient. Often, the adjuvant is selected from the group consisting of ABM2, AS01B, AS02, AS02A, Adjumer, Adjuvax, Algammulin, Alum, Aluminum phosphate, Aluminum potassium sulfate, *Bordetella pertussis*, Calcitriol, Chitosan, Cholera toxin, CpG, Dibutyl phthalate, Dimethyldioctadecylammonium bromide (DDA), Freund's adjuvant, Freund's complete, Freund's incomplete (IFA), GM-CSF, GMDP, Gamma Inulin, Glycerol, HBSS (Hank's Balanced Salt Solution), IL-12, IL-2, Imiquimod, Interferon-Gamma, ISCOM, Lipid Core Peptide (LCP), Lipofectin, Lipopolysaccharide (LPS), Liposomes, MF59, MLP+TDM, Monophosphoryl lipid A, Montanide IMS-1313, Montanide ISA 206, Montanide ISA 720, Montanide ISA-51, Montanide ISA-50, nor-MDP, Oil-in-water emulsion, P1005 (non-ionic copolymer), Pam3Cys (lipoprotein), Pertussis toxin, Poloxamer, QS21, RaLPS, Ribi, Saponin, Seppic ISA 720, Soybean Oil, Squalene, Syntex Adjuvant Formulation (SAF), Synthetic polynucleotides (poly IC/poly AU), TiterMax Tomatine, Vaxfectin, XtendIII, and Zymosan. Often, the vaccine composition includes an immune checkpoint inhibitor. In some cases, the immune checkpoint inhibitor is selected from one or more of the group consisting of a PD-1 inhibitor, a PD-L1 inhibitor, and a CTLA-4 inhibitor. Often, the immune checkpoint inhibitor is selected from one or more of the group consisting of Pembrolizumab, Nivolumab, and Atezolizumab. In some cases, the method further comprises administration of the personalized vaccine to the individual. Often, the vaccine is administered via a route selected from the group consisting of subcutaneous, intradermal, intramuscular, intranasal, intravenous, and sublingual. In some cases, the individual is a mammal. Often, the individual is a dog. In some cases, the cancer is selected from the group consisting of Acute lymphoblastic leukemia, Acute monocytic leukemia, Acute myeloid leukemia, Acute promyelocytic leukemia, Adenocarcinoma, Adult T-cell leukemia, Astrocytoma, Bladder cancer, Bone Cancer, Brain Tumor, Breast Cancer, Burkitt's lymphoma, Carcinoma, Cervical Cancer, Chronic Lymphocytic Leukemia, Chronic myelogenous leukemia, Colon Cancer, Colorectal cancer, Endometrial cancer, Glioblastoma multiforme, Glioma, Hepatocellular carcinoma, Hodgkin's lymphoma, Inflammatory breast cancer, Kidney Cancer, Leukemia, Lung cancer, Lymphoma, Malignant Mesothelioma, Medulloblastoma, Melanoma, Multiple myeloma, Neuroblastoma, Non-Hodgkin Lymphoma, Non-Small Cell Lung Cancer, Ovarian Cancer, Pancreatic Cancer, Pituitary tumor, Prostate cancer, Retinoblastoma, Skin Cancer, Small Cell Lung Cancer, Squamous cell carcinoma, Stomach cancer, T-cell leukemia, T-cell lymphoma, Thyroid cancer, and Wilms' tumor.

BRIEF DESCRIPTION OF THE DRAWINGS

Certain novel features herein are set forth with particularity in the appended claims. A better understanding of the features and advantages of the present disclosure will be obtained by reference to the following detailed description that sets forth non-limiting and non-exhaustive illustrative embodiments, in which the principles of the invention are utilized, and the accompanying drawings of which:

FIG. 1A shows 1,259 10-aa peptides were generated using the same method for MHC I prediction, y axis was the best prediction percentile rank for each peptide, reference to human HLA types is used. FIG. 1B shows 1,242-point mutation peptides were somatic cancer genome missense point mutations, 20 aa peptides were generated from the point mutation site, same number of 20-aa MS FS peptides and paired WT peptides were used for comparison, y axis was number of hits with percentile rank <10 in MHC II prediction.

FIG. 8A shows an example of 500 most common positive FSPs and 500 negative FSPs form 8 different dog cancers (BC: breast cancer, n=12; FSA: fibrosarcoma, n=5; HSA: hemangiosarcoma, n=12; LC: lung cancer, n=12; MCT: master cell tumor, n=14; MEL: melanoma, n=12; OSA: osteosarcoma, n=17, STS: soft tissue sarcoma, n=12) and 81 non-cancer normal controls. Each red spot indicates the serum sample (Y axis) has positive antibody reactivity to the FSP (X axis). The positive cut off value of each peptide was calculated by the average plus two fold of standard deviation of the normal controls' signal of that peptide. FIG. 8B shows an example of personalize FS antigens selection for 4 OSA patients. 20 FS positive antigens were selected from the highest IgG activity fold change to the cut-off value in each patient. FIG. 8C shows an example of personalized FS antigen selection for 4 MCT patients.

FIG. 9 shows an FSP array analysis of dog serum. 8 types of 116 dog cancer serum and 52 non-cancer serum were analyzed by the small FSP array. Each red spot indicates the serum has positive antibody reactive with this peptide.

FIG. 10A, FIG. 10B, FIG. 10C, and FIG. 10D show reactive FSPs showed protection in the mouse melanoma and breast cancer models. FIG. 10A shows reactive and non-reactive FSPs from the same microsatellite frameshift antigen of CIS (SEQ ID NO: 1524). FIG. 10B shows 3 groups of mice were used: the control group was immunized with control plasmid, non-reactive FSPs pool and reactive FSP. All 3 groups received 2 rounds of genetic immunization with gene gun and peptide boost via subcutaneous injection. The B16F10 cell line was used for the melanoma model and the 4T1 cell line was used for breast cancer model. Each group had 10 mice. FIG. 10C shows reactive FSPs slowed tumor growth significantly compared to the non-reactive FSPs pool and the control group in the melanoma model (student's t-test, p-value <0.01), error bar represented mean±SEM. FIG. 10D shows the Reactive FSPs offered tumor protection in mouse breast cancer model as well. The tumor volume was significantly lower than control group and non-reactive FSPs pool group (student's t-test, p-value <0.05).

FIG. 13A shows a corner of the scanned FS array of each cancer dog analysis. FIG. 13B shows normalized antibody active to each peptide of each dog with cancer. Both FIG. 13A and FIG. 13B showed each dog has personal highly reactive FS peptides.

FIG. 15A shows a trial schedule. FIG. 15B shows ELISA analysis of the IgG reactive to the vaccine. FIG. 15C shows IFN-r ELISPOT analysis of the T cell response to the vaccine.

FIG. 16A shows tumor growth curve by three MS FS antigens immunization with 4T1-BALB/c tumor model. Mice (n=10 per group) were genetically immunized at 8 weeks of age, boosted twice genetically 3 weeks later with two days apart and another peptide boost 2 weeks later. Mice were challenged 2 week later by subcutaneous injection of $5 \times 10^3$ 4T1 cells. All vaccine groups significantly delayed tumor growth. FIG. 16B shows ELISPOT analysis of the three MS FS antigen immunization. Three mice were genetically immunized with pool of the three MS FA antigens and genetically boosted 6 weeks later. Immunized mice were challenged by $5 \times 10^3$ 4T1 cells 3 weeks later. Splenocytes were collected at 19 days after tumor challenge and pool three splenocytes for the assay.

Error Bars Represent SD.

Figure 17A:
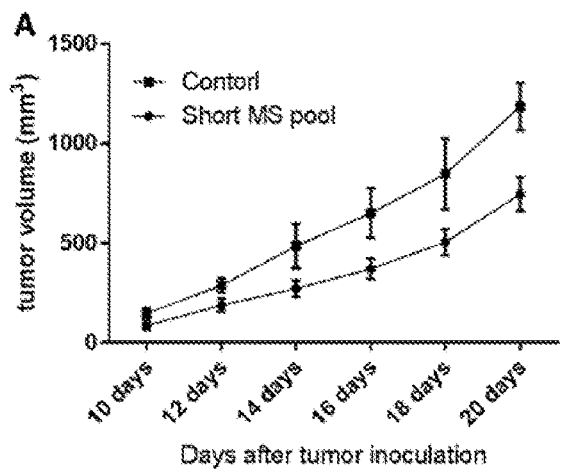
Figure 17B:
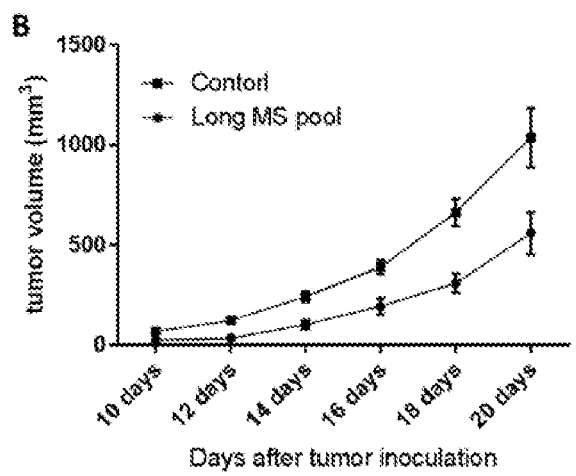

FIG. 17A and FIG. 17B show that FSPs have significant protection as vaccine candidates in different mouse tumor model. Tumor growth of curve the vaccine test of the two FSPs pool from short and long MS in 4T1-BALB/c tumor model. FIG. 17A shows tumor growth curve with short MS FSPs vaccine group. FIG. 17B shows tumor growth curve with long MS FSPs vaccine group.

Figure 18A:
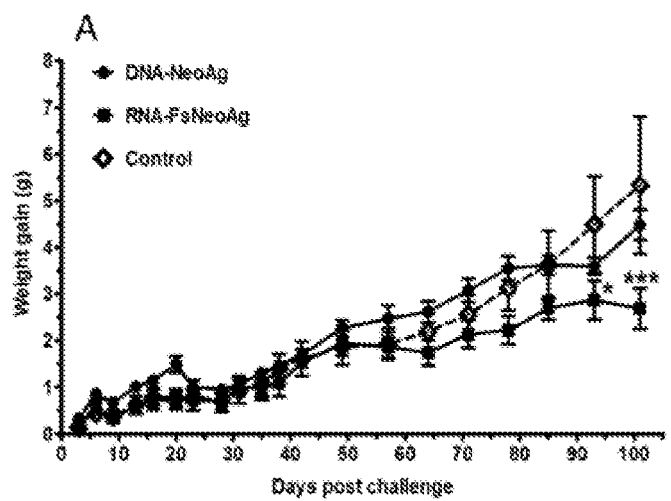
Figure 18B:
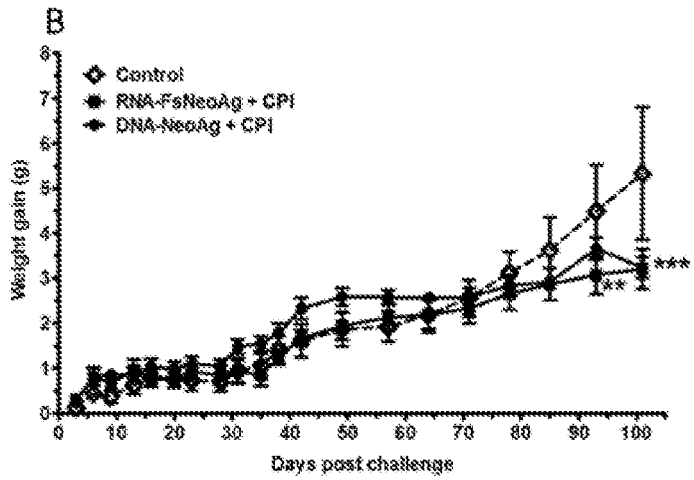

FIG. 18A and FIG. 18B show that FSPs have significant protection as vaccine candidates in different mouse tumor model. Therapeutic immunization with FS antigens against ovarian cancer in mouse model. FIG. 18A shows female C57BL/6 mice (n=10) were challenged intraperitoneally with 1D8 ($5 \times 10^5$ cells/mice) at day 0 and then, immunized subcutaneously 3 times with pool of FSPs (RNA-FsNeoAg) (10 FS from MS INDEL and 3 FS from mis-splicing) or neo antigens from DNA mutations (DNA-NeoAg) at days 3, 6 and 78. Control group mice were injected PBS buffer. FIG. 18B shows the vaccine group received additionally a checkpoint inhibitor treatment (CPI) composed by antibody anti-PD-L1 and CTLA-4, six times divided in two sets. Mice were weighing once a week until reach endpoint.

Figure 19:
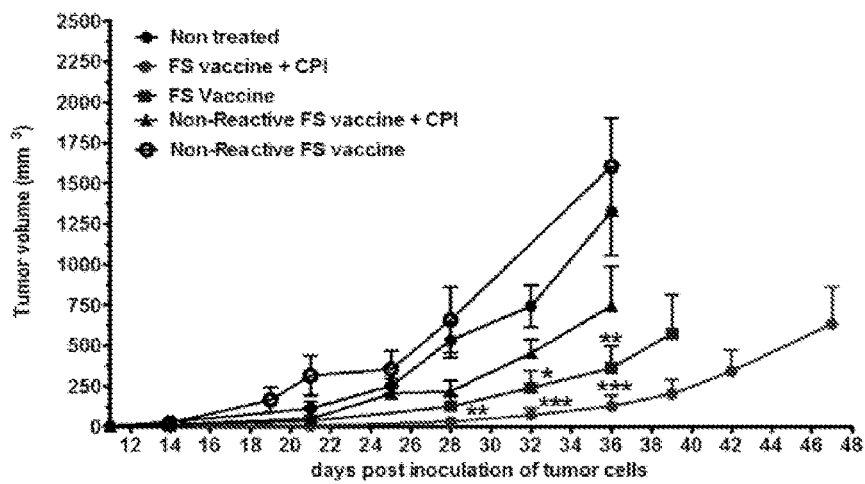

FIG. 19 shows the SPCV system successfully identified protective personalized cancer vaccines in two mouse tumor models. Protection by personalized pool FS neoantigens in 4T1 BALB/c tumor model. Serum from BALB/c mice (n=10/group) were collected two days previous and 7-days post subcutaneous injection of 4T1 tumor cells (500 cells/mouse). Both sera were run on microarray slides containing peptides for human FS neoantigens and the 10 mouse homologs neoantigens with higher median normalized signal on the array were selected as targets for the vaccines formulations for each mice. Mice were vaccinated subcutaneously on days 12 and 19. For the immunization group with the combined immunotherapy, the antibody treatment, anti-PD-L1 and CTLA-4, were administrated intraperitoneally on days 12, 15, 19, 22. Control group (non-treated) was immunized with PBS at the same schedule as the vaccine groups. Non-reactive groups were immunized with FS antigens without signal in the microarray before and after tumor challenge, and followed the same vaccine regimen as the other groups. *$p<0.05$; $p<0.01$; *$p<0.001$, analyzed by two-way ANOVA with Bonferroni multiple comparisons post-test.

Figure 20:
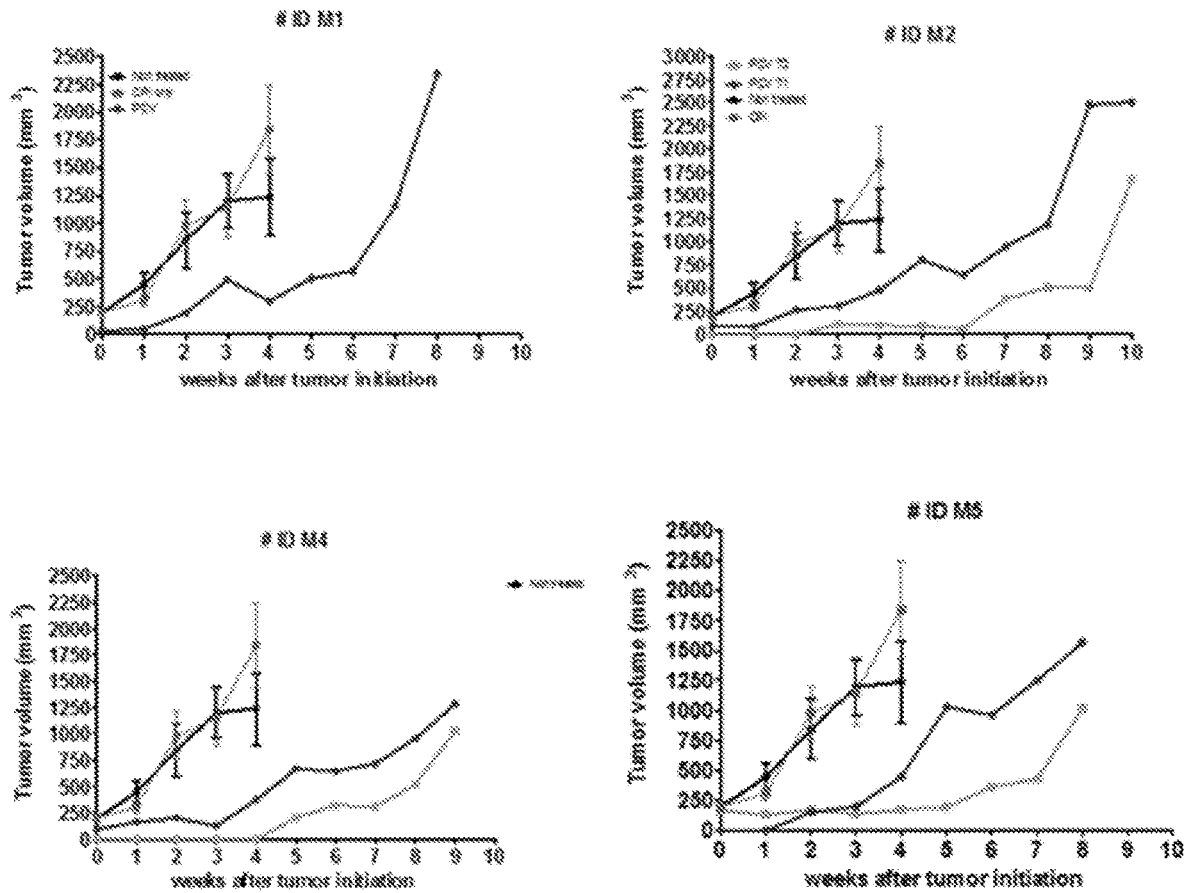
Figure 20:
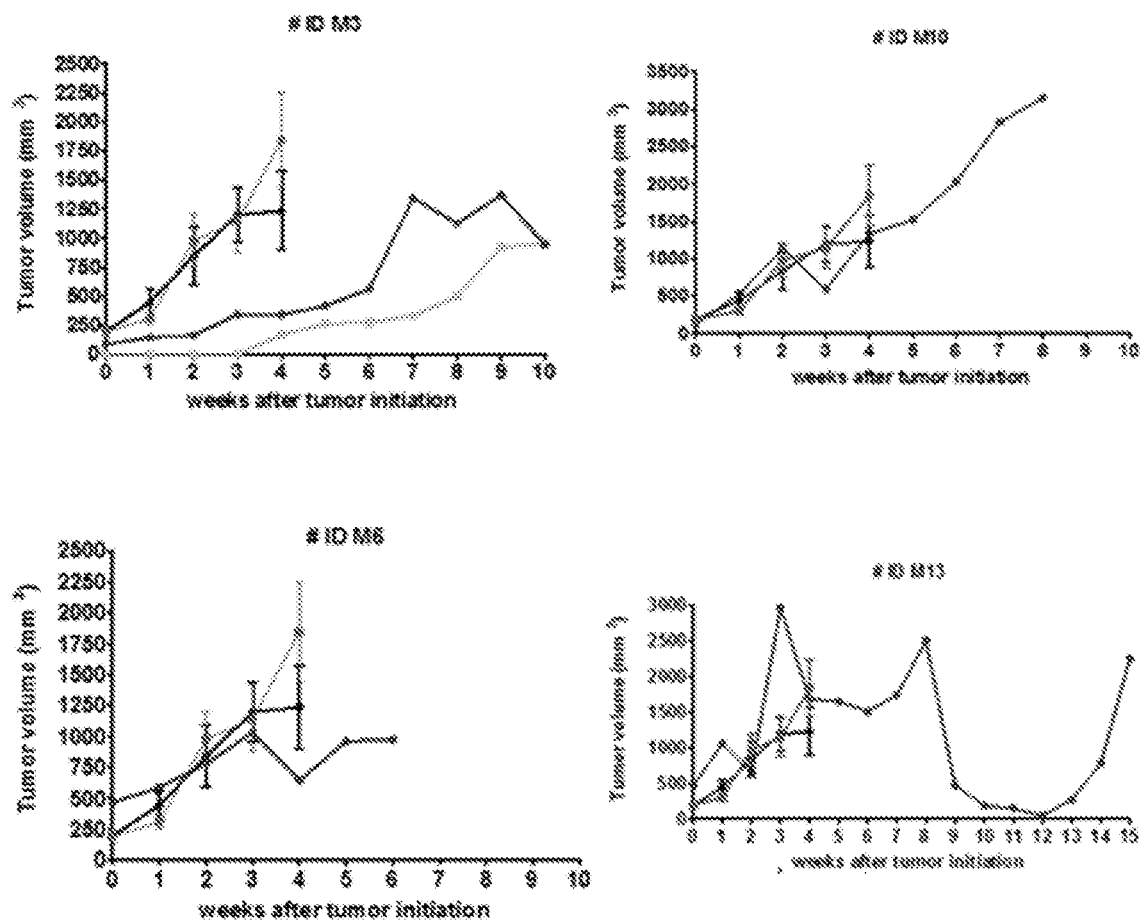
Figure 20:
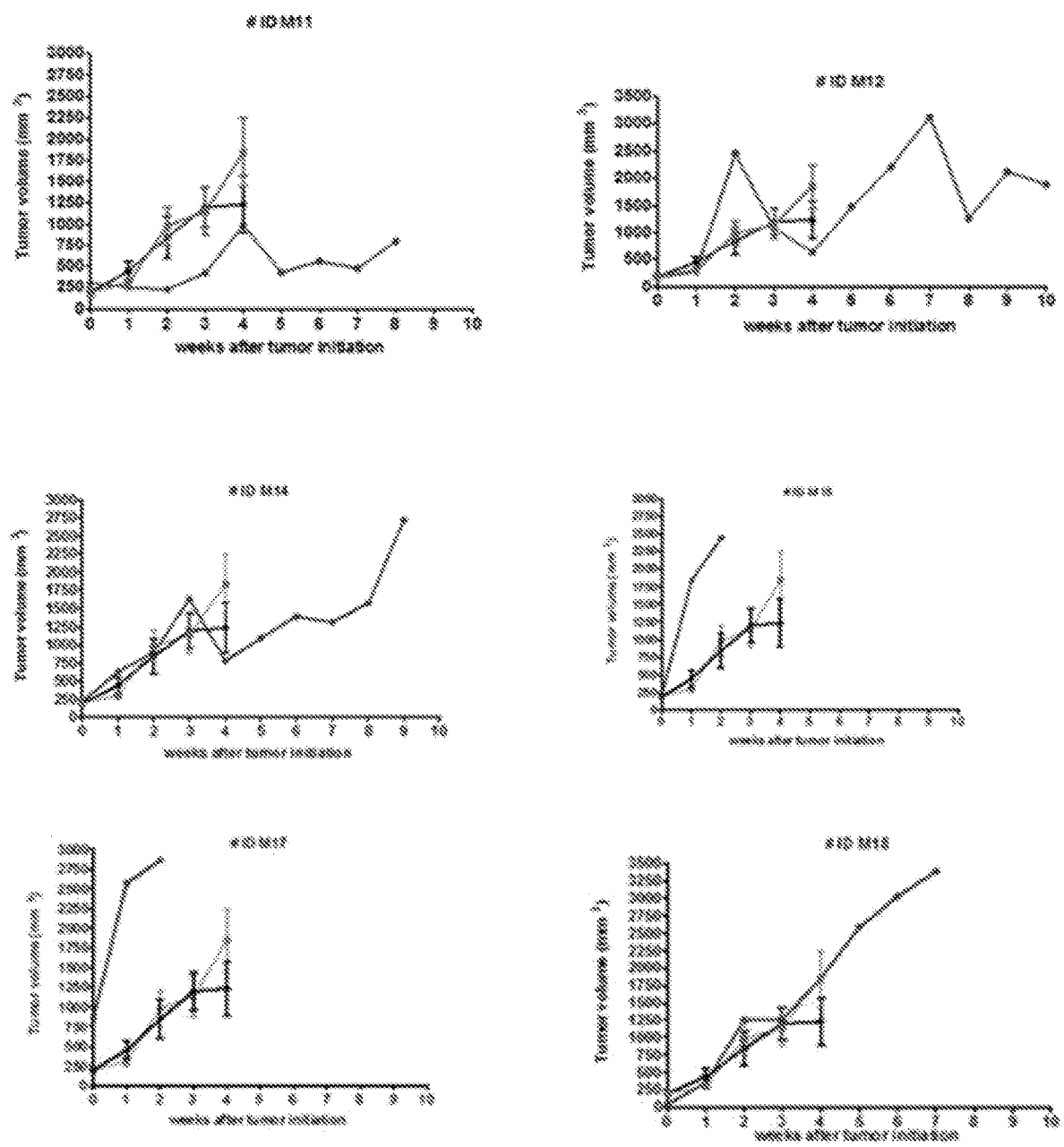
Figure 20:
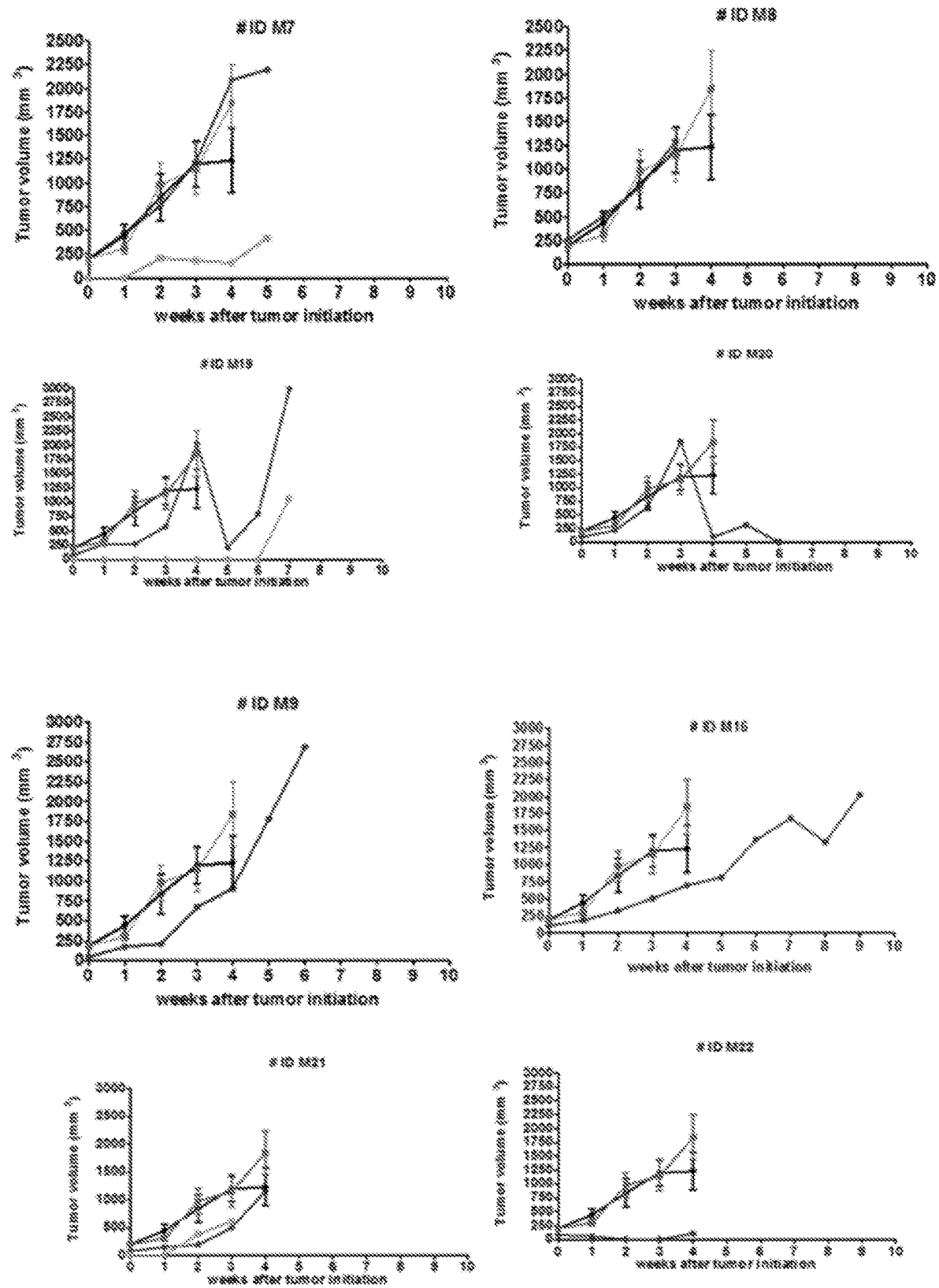

FIG. 20 shows the SPCV system successfully identified protective personalized cancer vaccines in two mouse tumor models. Female FVB/N mice (n=22) were evaluated weekly for the presence of palpable tumor, when tumor was detected sample blood was collected and run on microarray slides containing peptides for human FS neoantigens. The 10 mouse homologs neoantigens with higher median normalized signal compared to age matched FVB/NJ samples on the array were selected as targets for the vaccines formulations for each mice. Mice were vaccinated subcutaneously with pool of FS peptide with minimum two doses and maximum seven doses, as needed to maintain tumor control, with intervals 1-2 weeks between doses. Each vaccine dose was followed by checkpoint inhibitor treatment (antibody anti-PD-L1 and anti-CTLA-4) (CPI), two doses, three days a part. As a control group, we immunized animals with PBS (non-treated) at the same schedule as the vaccine groups or only with CPI treatment (CPI only), twice per animal. Personalized FS vaccine conferred 68.2% of protection.

DETAILED DESCRIPTION

Figure 1A:
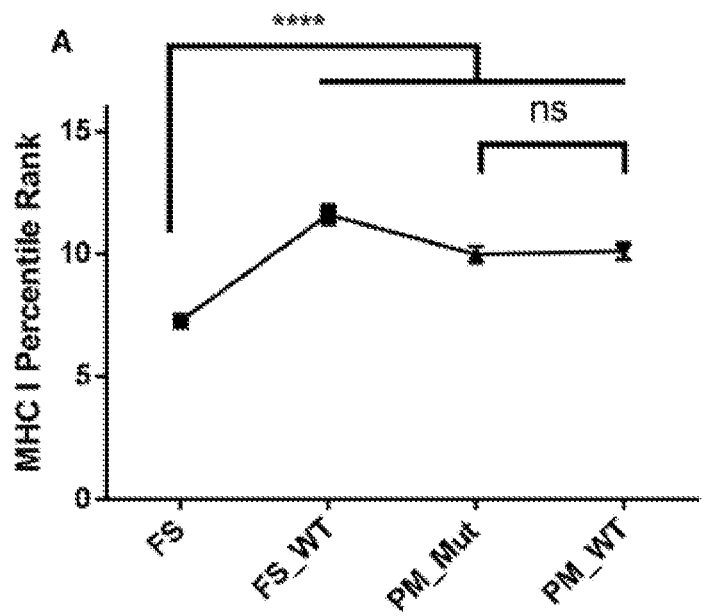
FIG. 1A and FIG. 1B show a bioinformatics comparison demonstrating that FS are superior neo-antigens to point mutations. MHC Class I and II prediction for MS FS peptides and point mutation peptides. FS: MS FS peptide, FS_WT: FS peptide paired WT peptide, PM_Mut: point mutated peptide, PM_WT: point mutation paired WT peptide. Reference to human HLA types is used.
Figure 1B:
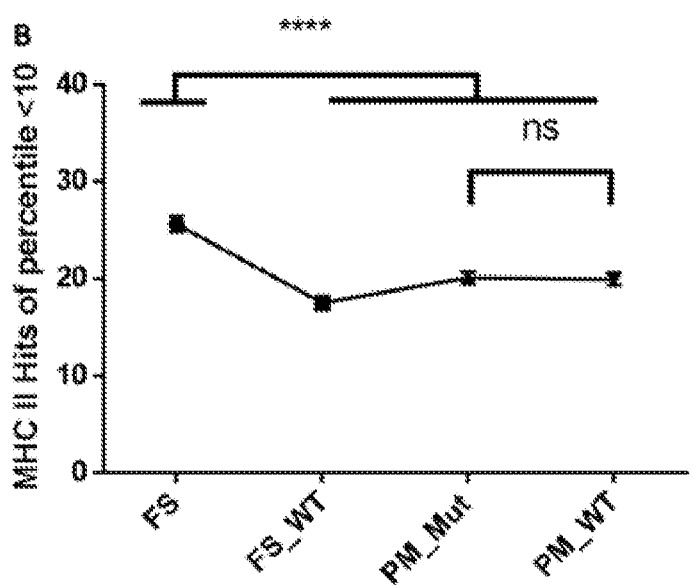

Provided herein is a novel approach to personalized cancer vaccines that overcome the limitations of conventional methods. The advent of the use of immunotherapeutics has resulted in emphasis on the importance of neo-epitopes in the immune response to cancer. Neo-epitopes are peptides that are normally not produced to an immunologically recognized level in healthy cells, but are so in tumors. They are essentially foreign epitopes. Of the neo-epitopes, frameshifts peptides (FS) are the best antigens as shown in FIG. 1. FS neo-antigens were the basis for the first tumor agnostic approval of a checkpoint inhibitor. It has been established based on sequencing the DNA of ~100,000 tumors that millions of neo-antigens are produced by tumors, with very few of them repeated in different tumors, even among tumors the same type and FS at the DNA level are very rare. Therefore, conventionally, it has been thought that to develop a personalized cancer vaccine, each tumor would need to be sequenced as well as the non-tumor cells (germline) for each person. Further, it is not feasible to create a library of all the possible neo-antigens to create a personal vaccine. Therefore, each set of neoantigens would have to be customized and manufactured for each patient after the determination of the appropriated vaccine components. Since most neo-antigens are the product of point mutations, and only a small portion of these are immunogenic (~3%) in patients, current methods involve application of a complicated informatics approach to predict the best vaccine components. The current basic concept as described in the art is that personal neoantigens in one's tumor are developed by sequencing the patient's tumor. The germline sequence of the patient would also be analyzed for comparison purposes. The developed neoantigens Would then be informatically screened to predict which are likely to be immunogenic, and a vaccine manufactured for these particular antigens and delivered in a timely fashion to the patient. In some instances, it is envisioned that this personal vaccine would be delivered with a checkpoint inhibitor. However, personal cancer vaccine development and the checkpoint inhibitor are both expensive. We have developed a system to create a personal vaccine that is much faster and less expensive than existing methods, yielding more immunogenic antigens for a personal cancer vaccine.

Figure 2:
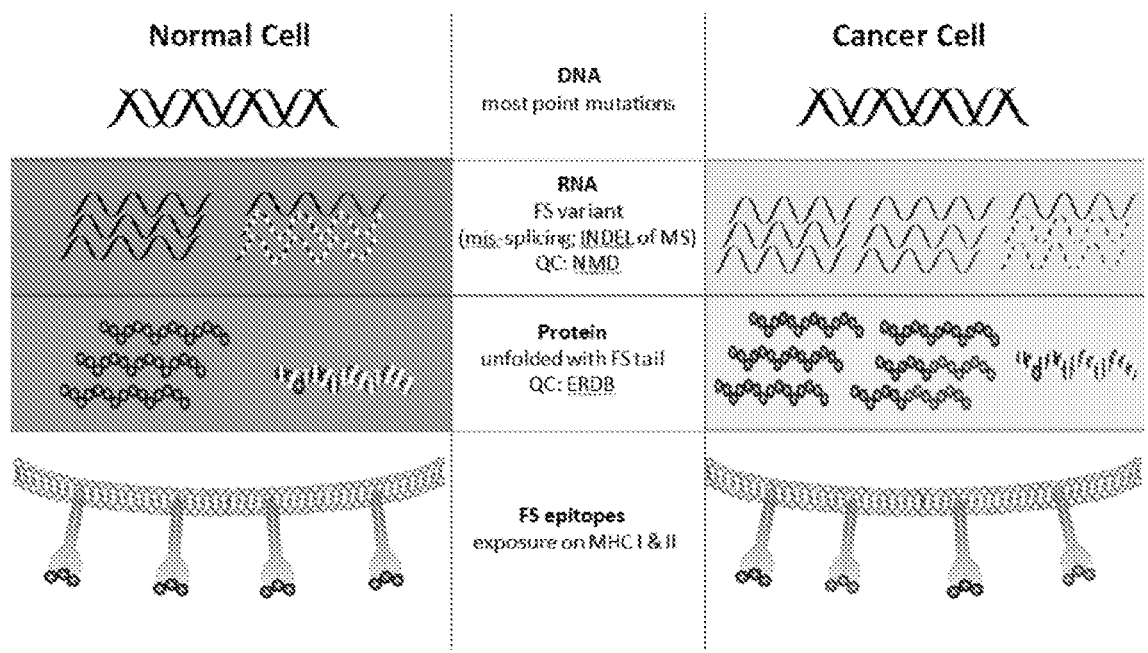
FIG. 2 shows a model of the FS antigens from the FS RNA variants and illustrates the basic theory behind the importance of RNA generated FS peptides from mis translation through microsatellites. Normal Cell: Errors in DNA replication are very low and repaired. Transcription error rates are higher but also rare as are mis-splicing in intron excision. Any frameshift (FS) transcript with premature stop is the degraded target of nonsense-mediated decay (NMD). Aberrant proteins, including those with frame-shifts are largely eliminated by the protein quality control system. The net result is that very few FS peptides are presented on MHC I/II or escape the cell to be presented to the immune system. Cancer Cell: In general more RNA is produced and increased error rates are observed at the DNA, RNA, and protein levels. More errors are made in DNA replication, but only in dividing cells. Most DNA mutations are single nucleotide changes and encode low or non-immunogenic peptides. Transcription is generally less accurate, especially through microsatellites (MS), producing insertions and deletions (Indels). Most transcribed genes with MSs in the coding region will have more FS transcripts. RNA splicing is also far less accurate in cancer cells, creating more FS transcripts from each out of frame splicing between exons form the same gene and different genes. The large increase of the FS transcripts from Indels of MS and mis-splicing overwhelms RNA quality control systems, such as NMD. Consequently, more truncated proteins with the FS peptide will be translated. These un-folded proteins, combining with aberrant proteins from other variants, overwhelms the protein quality control system leading to more FS peptides being presented on MHC II and mis-secreted or released from the cancer cell and elicit an immune response.
Figure 3:
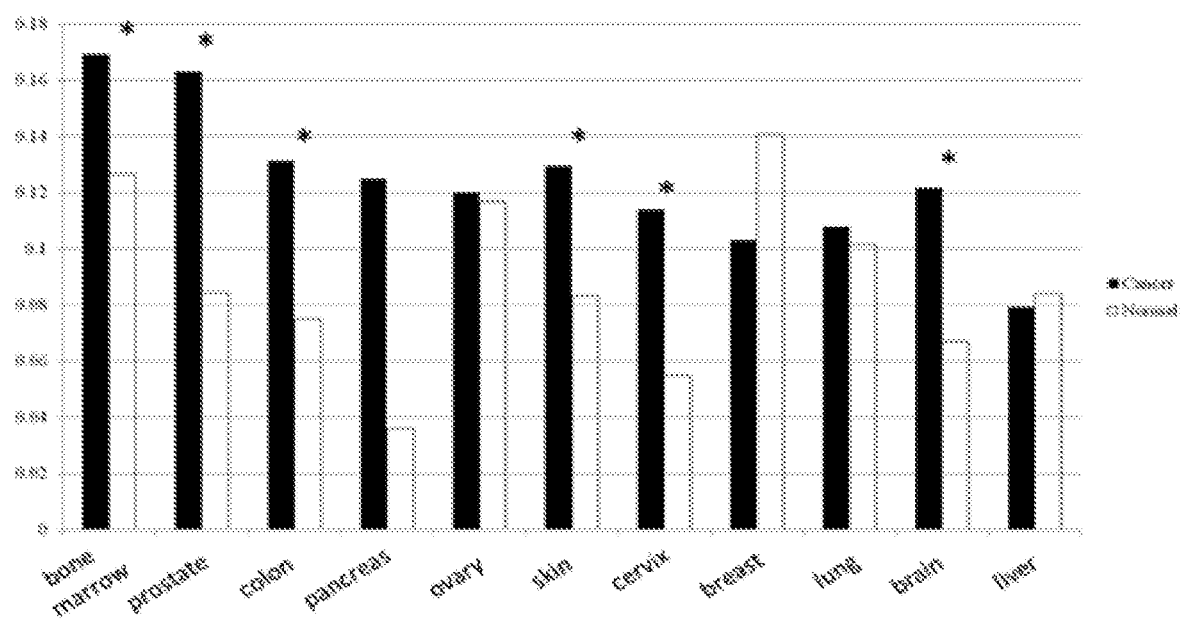
FIG. 3 shows cancer ESTs have more MS INDELs than normal ESTs. Analysis of homopolymer (repeat bp>6) MS INDEL rate in EST database between different cancer and normal libraries.* indicate P<0.0001.
Figure 4:
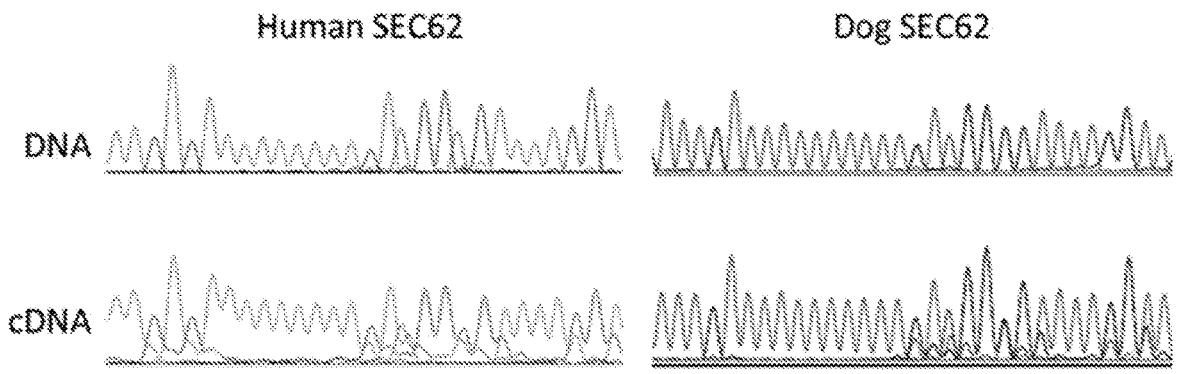
FIG. 4 shows MS INDELs only exist in RNA not DNA. Examples of the sequence traces of MS region in SEC62 homolog genes in paired DNA/cDNA samples. Four human breast cancer cell lines were sequenced: HTB26, CRL2315, CRL1504, CRL2326; 5 dog mast cell tumors and 3 dog carcinomas. They all showed similar pattern, where the A MSs have an A insertion in RNA not in DNA.
Figure 5:
FIG. 5 shows how an insertion or deletion in transcription of a MS would each produce a different FS peptide. This figure shows an example of frameshift peptides produced by either an insertion or deletion in the A MS in the Sec62 gene. Figure discloses SEQ ID NOS 10669-10674, respectively, in order of appearance.
Figure 5:

We have discovered that a smaller subset of neo-antigens ("frameshift neo-antigens") can be utilized to develop a personalized cancer vaccine. This is an important advance because the number of frameshift (FS) neo-antigens is much smaller than the total of all possible neo-antigens. We have discovered that FS peptides are frequently and recurrently produced in tumor cells. These FS peptides are produced by insertion and deletion variants (INDELS) occurring in microsatellite regions or by mis-splicing of RNA (FIG. 2). The microsatellite generated FS are predictable and will be made in each tumor that expresses the gene containing them. The mis-splicing events are also predictable and the ones that actually occur are detectable by the FS peptide arrays described. Our discovery that FS antigens occur more frequently and more recurrently in different tumors in the RNA by transcription or mis-splicing is surprising (FIG. 3). These INDEL variants only exist in the RNA, not in the DNA (FIG. 4). There are approximately 14,000 potential FS peptides transcribed from microsatellites in exons and approximately 200,000 potential FS from mis-splicing. We have also discovered that tumors make INDEL variants (FIG. 5) in most microsatellites and that mis-splicing is also recurrent at the same genes in tumors. We can also further limit the number of candidate FS peptides by restricting them to ones that are at least 8 amino acids long and/or in oncogenes, essential genes and or highly expressed genes. These genes would be more difficult for a tumor to evolve away from. Therefore, it is only necessary to screen a limited number of approximately 1000 to 200,000 FS peptides to determine the components of a personal vaccine. This screen can be done in a day or less, rather than a month or more by current practice, and at much lower cost.

Most importantly, there is no dog personal cancer vaccine available and even in the trial. With the matured DNA sequence and analysis pipeline, the human personal cancer vaccine as currently envisioned would cost>$50,000. Dog DNA sequence and analysis is much more difficult, and the cost of such vaccine should not be affordable to most owners. Disclosed herein are several methods and systems for such non-sequencing based screens. All approaches to date described in the art begin with sequencing the DNA and RNA of the patient. An important aspect of our approach is that our immunological screens indicate that the FS peptides are produced by the tumor and are reactive with the immune system, which is not the case with current protocols which only sequence the RNA to determine if the gene is transcribed. Further, the number of candidate FS antigens could be restricted to a low enough number to allow the vaccine components, i.e. frameshift neo-antigens, to be pre-synthesized and the personal vaccine readily formulated for each patient. This potentially simplifies regulatory approval of the personal vaccine approach by making uniform certain constituents of the personal vaccine across patient populations.

Figure 6:
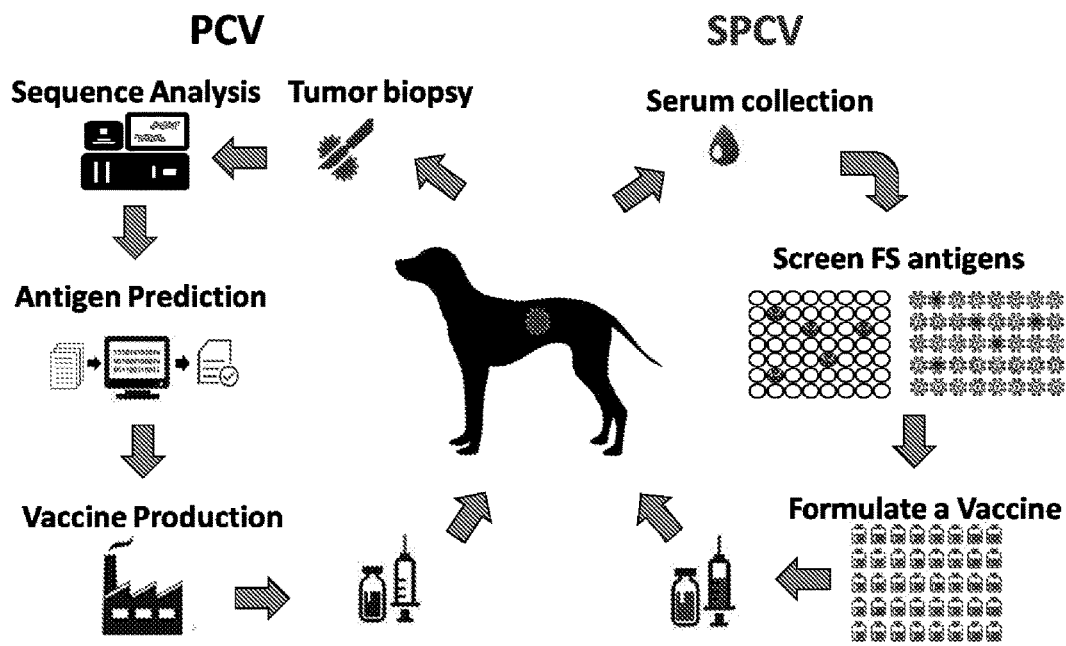
FIG. 6 shows a comparison of the current approach to making personal cancer vaccines (PCV) versus a much simpler and faster system (SPCV).

A comparison of the current approach to making personal cancer vaccines (PCV) (as described in patents, for example US 2016101170) to our method of making simple personal cancer vaccines (SPCV) disclosed herein is illustrated in FIG. 6. The two systems vary fundamentally at almost every step:

Step 1. The PCV requires taking a biopsy of the patient's tumor. In contrast, the SPCV only requires a small amount of blood. Because blood can readily be obtained, unlike tumor biopsies, the patient can be continuously monitored relative to the vaccine response and tumor status.

Step 2. In the PCV the tumor DNA and RNA are sequenced, as well as the patient's germline, to find to determine candidate tumor mutations. In the SPCV, blood samples are assayed to directly determine which tumor variants are both expressed and have an immune response in the patient.

Step 3. The PCV system requires applying an algorithm to estimate which of the mutations might be expressed as peptides and the immune system would respond to. This is not required by SPCV, since any expressed FS of 8aa or longer would be highly likely to elicit an immune response. Moreover, since the screen is for immune reactivity, the results directly indicate that the neo-antigen is expressed and immune reactive.

Step 4. In several embodiments of the peptide arrays in SPCV, the numbers are small enough that the peptides could be pre-made. This would allow, for example, screening candidate peptides directly in T-cell assays to determine specific immunogenicity in patients. This is not practical for the PCV approach as it would take too long to get the information.

Step 5. In the PCV system it is expected it will take at least 2 weeks or more to manufacture the vaccine for the patient. Currently it takes months. Because the domain of possible mutations in PCV assays is so large, the manufacturing will need to be specific for each person. In contrast, in several embodiments of the SPCV arrays, the number of variants are small enough such that the collection of possible vaccines can be pre-made, greatly reducing the time to get back to the patient. This would also allow the vaccine components to be pre-validated by the FDA, which currently cannot be done for the PCV system and thus poses a potential regulatory problem. These comparisons are summarized in Tables 1 and 2. In the PCV system even if the manufacture of the vaccine as peptide or nucleic acid can be improved to take less time, the SPCV system is inherently still better as the FS antigens will be much more broadly immunogenic.

Figure 7:
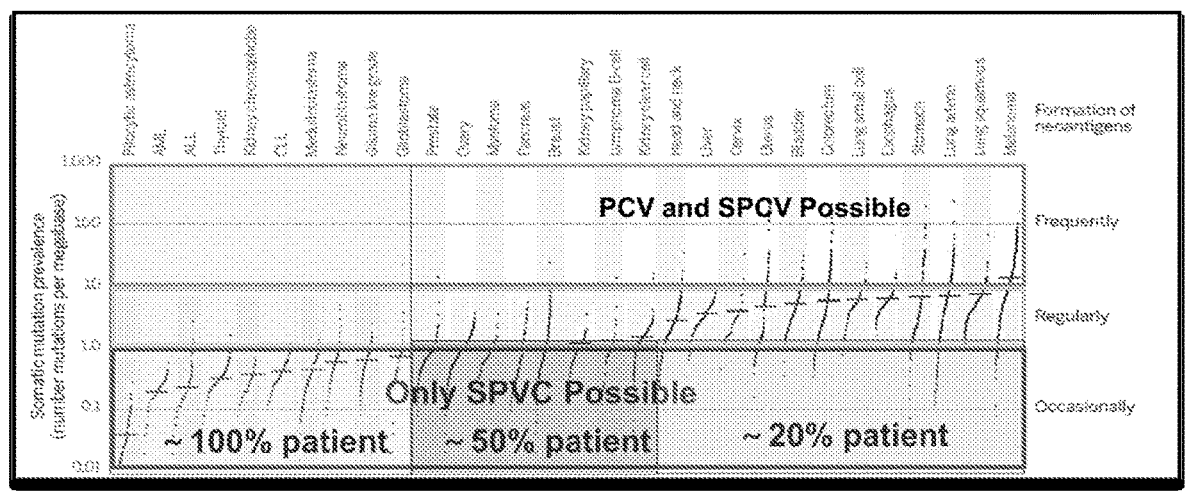
FIG. 7 shows an exemplary embodiment of SPCV in low mutation burden cancers.

Step 6. The current PCV cannot find enough neo-antigens from low mutation burden cancer patients, which is about 30% of total cancers and almost 100% of certain types of cancer. The SPCV potentially works all types of cancers (FIG. 7).

TABLE 1

Comparison of PCV versus SPCV

|  | Traditional PCV | SPCV |
|---|---|---|
| Ag Identification | ≥2 weeks | 1~5 days |
| Ag Immunogenicity | Algorithm Predicted (3%) | confirmed |
| Vaccine Production | ≥2 weeks | 1 days |
| Cost | $$$ | $ |

TABLE 2

Peptide Numbers

| FS mutation category | peptide number | methods for screening |
|---|---|---|
| All Possible FS mutations | ~2*10$^6$ | Phage or RNA display |
| All possible splice variants FS | ~6*10$^5$ | In situ synthesized arrays |
| All MS FS | ~2*10$^4$ | Spotted arrays |
| All MS FS in Driver genes | ~2*10$^3$ | Spotted arrays or micro titer plates |
| All MS FS in Essential genes | ~1.6*10$^3$ | Spotted arrays or micro titer plates |

Disclosed herein are streamlined, cost effective, and efficacious methods to design and produce personal vaccines for dogs, such as personal canine cancer vaccines. Methods herein include methods of determining the optimal components of a vaccine to be given to an individual to treat the cancer in that individual. Such methods include determining whether a candidate vaccine peptide is both expressed in the tumor of the individual and elicits an immune response in the individual. In some embodiments, the methods herein disclosed comprise obtaining a blood sample from an individual diagnosed with a cancer or a pre-cancer, diluting the blood sample in a buffer, contacting the diluted blood sample to a collection of peptides, wherein the collection of peptides comprises predicted frame-shift peptides that may be produced by a cancer cell from the individual. In some embodiments, the collection of peptides is an array, a high density array, a phage library, a plate-based assay, or other means of assembling a pre-determined collection of frame-shift peptides for testing against patient samples, including blood, serum, plasma, saliva, cerebrospinal fluid, and others. The results of the assay determine which peptides have strong (e.g. $K_D>10^{-8}$) binding to antibodies in the patient's blood compared to an average binding in blood from people without cancer or compared to a sample taken from the individual before they had cancer. In additional embodiments, variant peptides could be used in assays for T-cell reactivity using cells from the same patient. Peptides eliciting a strong response in T-cell activity assays are more likely to be good vaccine components, an assay which can be personalized with an individual's T-cell samples. Those peptides with high reactivity can form the basis of a personal vaccine to treat the individual's cancer. Variants or FS antigens herein are the products of alterations at the RNA level, such as errors in transcription of RNA processing. This is in contrast to germline "mutations" which occur in the DNA and are heritable.

Vaccines designed using methods herein could comprise the personalized set of peptides in a number of forms, including as a DNA vaccine, a peptide vaccine, an RNA vaccine, a viral vaccine, a bacterial vaccine or combinations thereof. Vaccines herein can also be loaded or incorporated into antigen presenting cells, such as dendritic cells or macrophages and the loaded cells administered to the individual. Alternatively, genes encoding the vaccine antigens can be used to transform antigen presenting cells through techniques known by those of skill in the art such as CRISPR transfection, viral or vector transduction, or other gene transfer or incorporation technology.

Vaccines designed using methods herein could also be given to an individual to prevent reoccurrence of a cancer. Collections of peptides herein developed in individual patients could also be used, for example, to diagnose cancer in other patients.

Figure 10C:
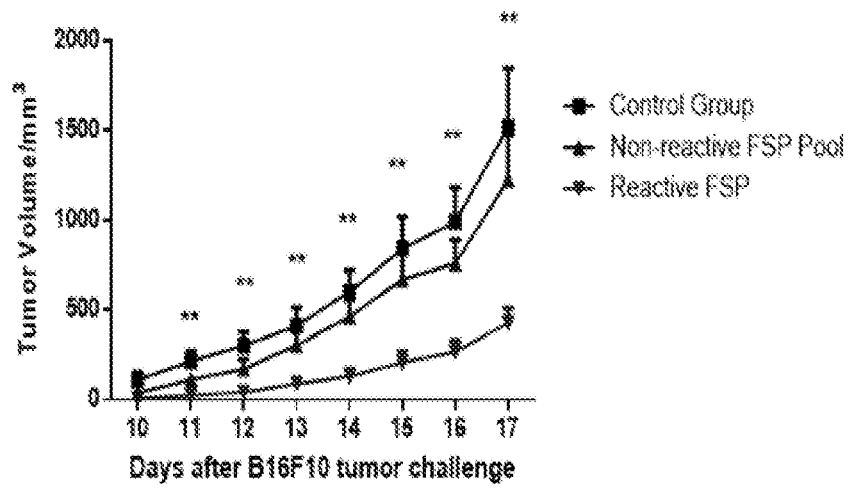
Figure 10D:
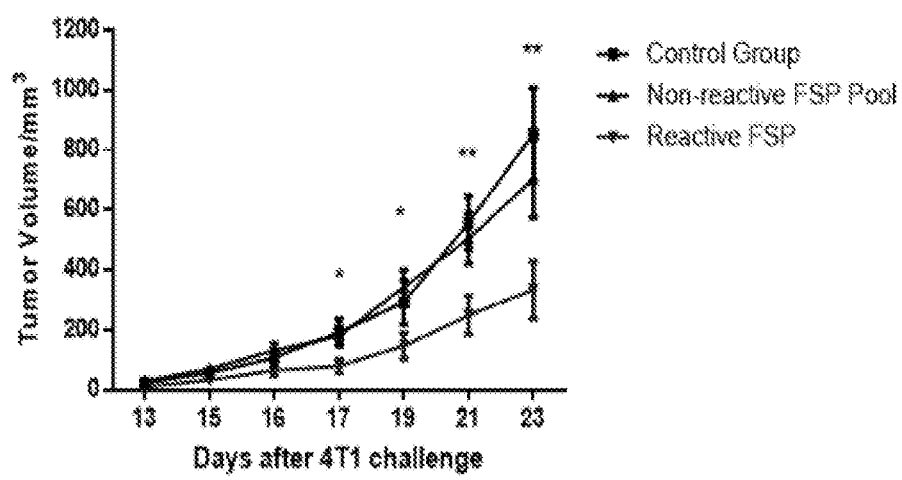
Figure 11:
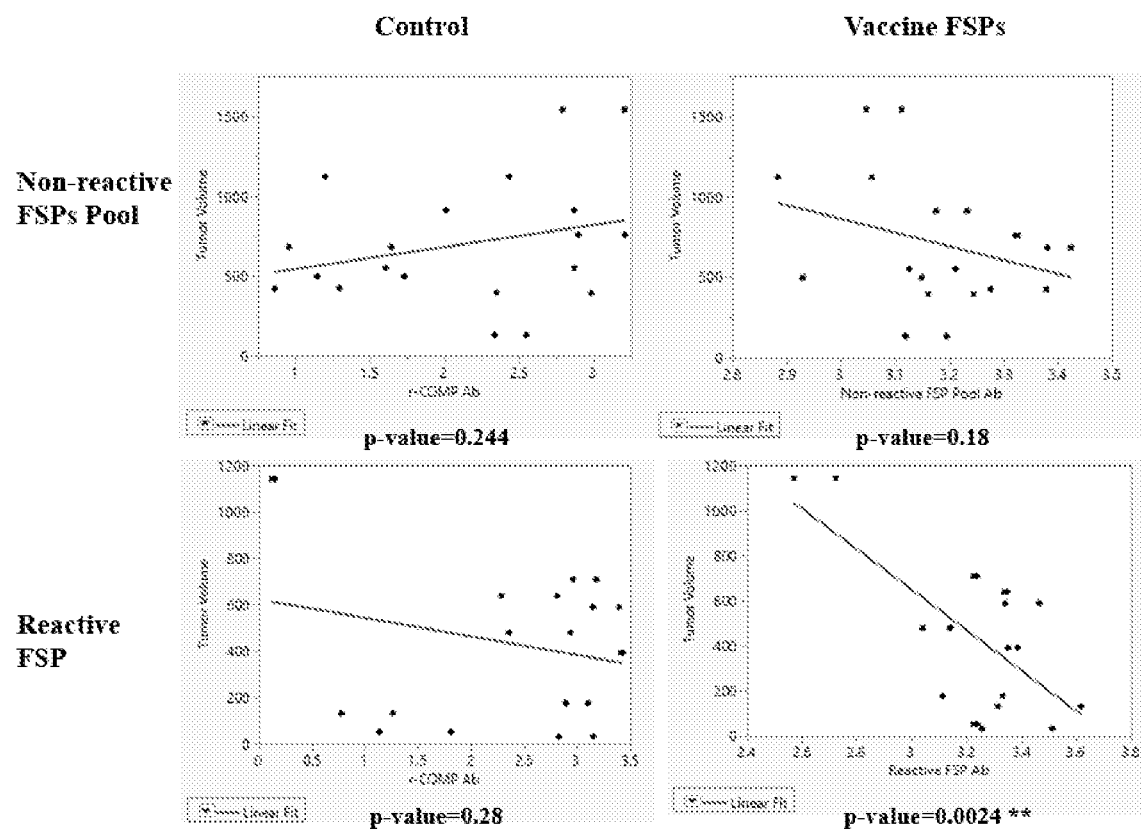
FIG. 11 shows screen dog cancer serum with a small FSP array. The reactive FSPs have protection and correlated with vaccine elicited antibody reactive. Tumor volume was linearly correlated to antibody response against vaccinated reactive FSPs in the 4T1 breast cancer model. Tumor volume at the end point was used for analysis. The antibody response was measured by ELISA after PB2 and at the end point. R-COMP peptide was encoded in a plasmid and used as an internal control for genetic immunization. The p-value was calculated for linear fit of antibody response against tumor volume.

The variant peptides comprising the collection for screening could be from several sources. They could be peptides known to result from point mutations, frameshifts, deletions/insertions or translocation in tumor DNA. Because these types of mutations are personal and occur infrequently, it would take a large number of peptides to represent all of them. Conventional practice is to determine neo-antigens encoded at the DNA level and then confirm expression at the RNA level. We have unexpectedly discovered that mutations occur much more frequently at the RNA processing level. Since microsatellites in coding regions are predicted and limited in number, one can predict a small set of FS peptides resulting from insertion or deletions during transcription that will produce FS neo-antigens. Therefore, methods herein, in some embodiments, comprise screening frameshift variants formed from 1) insertions or deletions in microsatellites in coding regions or 2) from mis-splicing events either in or between genes that create an out-of-frame fusion. These variants have several attractive features as sources for a personal vaccine component. First, frameshift variants generally have variant peptide sequences of over more than 8 amino acids. In contrast with point mutations that often only alters one amino acid, a FS variant is completely foreign sequence and therefore is much more likely to be immunogenic. Our work indicates that there are only a few thousand frameshifts from microsatellite insertion/deletions that are more than 8 amino acids long. Frameshifts of 8-60 amino acids long are very likely to include MHCI and MHCII epitopes. Further, because of their increased immunogenicity, FS variants are much more likely to create both T- and B-cell responses. Therefore, fewer peptides are required to be screened to determine vaccine components. Point mutation neo-epitopes are unlikely to produce both B and T-cell responses. Even though the arrays we developed (FIG. 8A, FIG. 9) record B-cell responses to the FS peptides, the antibody response level on the arrays correlates with the tumor protection (FIG. 10, FIG. 11). This may be because the antibody response requires CD4 help and it has been discovered that CD4 responses are important for protection. Further, the realm of FS space is much more restricted than that of all possible point mutations. This is particularly true for INDELS in microsatellites in coding regions. There are 2 possible FS that can be predicted from each of the ~7000 microsatellites in coding regions. These numbers become smaller as putative peptides are filtered for restrictions for minimal length (e.g. >7aa) and the probability of eliciting immune responses. This makes it feasible to have a pre-existing set of FS peptides made that can be used to screen the T-cells of a patient for reactivity.

Peptides to be screened by the methods herein are produced and displayed in a number of ways. For example, in some embodiments the peptide candidates are synthesized and spotted on arrays. In some embodiments, arrays have about 100 selected FS peptides. In some embodiments, arrays have about 200 selected FS peptides. In some embodiments, arrays have about 300 selected FS peptides. In some embodiments, arrays have about 400 selected FS peptides. In some embodiments, arrays have about 500 selected FS peptides. In some embodiments, arrays have about 600 selected FS peptides. In some embodiments, arrays have about 700 selected FS peptides. In some embodiments, arrays have about 800 selected FS peptides. In some embodiments, arrays have about 900 selected FS peptides. In some embodiments, arrays have about 1000 selected FS peptides. In some embodiments, arrays have about 10,000 selected FS peptides. In some embodiments, arrays have about 20,000 selected FS peptides. In some embodiments, in-situ synthesis could produce an array having 1,000,000 or more peptides per array, or at least 1000, 10,000 or 100,000 or 400,000 (FIG. 8A, FIG. 8B, FIG. 9) peptides per array.

Figure 12:
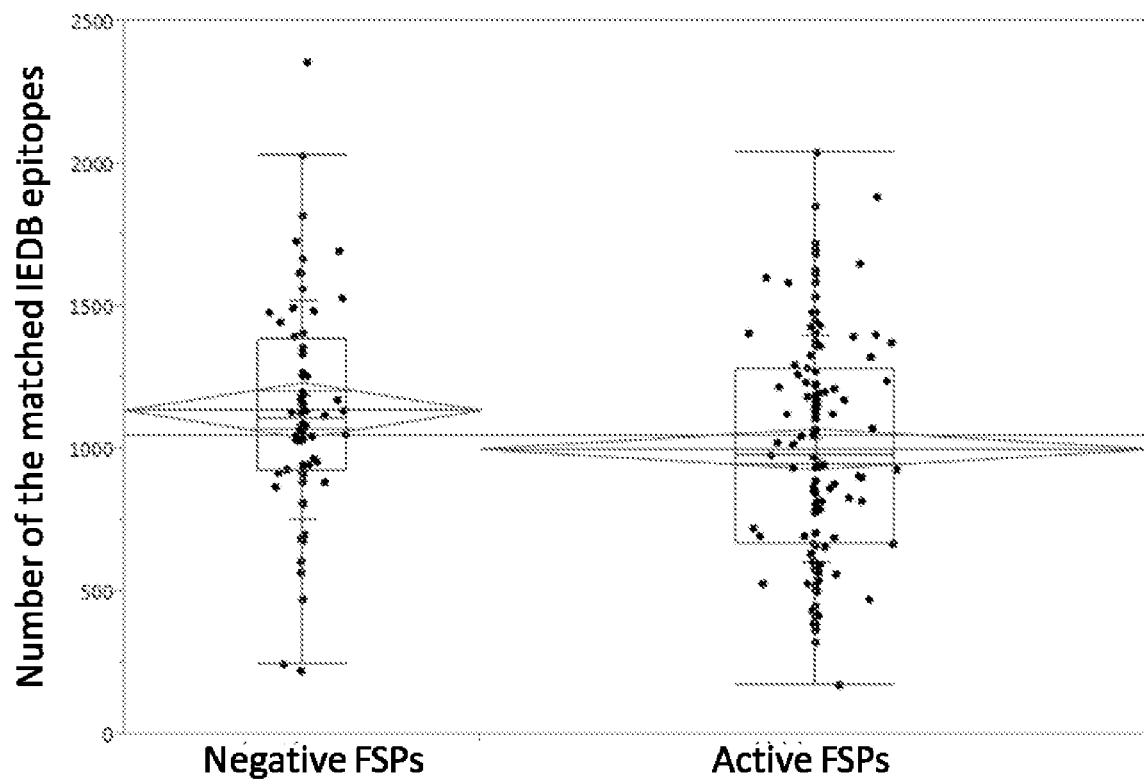
FIG. 12 shows that the negative FSPs have more pathogen epitopes than the highly active FSPs. This figure compares the negative FSPs with active FSPs in cancers. All negative FSPs and the FSPs with >10% positive rate in cancers from FIG. 9 were selected for analysis. A BLAST search against the Immune Epitope Database (IEDB) shows differential similarity with pathogen of peptides from these two sets of FSPs. Each peptide was searched using BLAST against epitopes in the IEDB and all the epitopes having an e value less than 10,000 were recorded as the matches. The number of the matched epitopes of each peptide was put into boxplot and represented the pathogen similarity of that peptide. The difference in similarity was statistically calculated with T-test P<0.05.

In an exemplary method of developing a personalized cancer vaccine, the blood from a cancer patient is diluted and applied to the array. After incubation the array is washed and the bound patient's antibodies are detected with a labeled secondary antibody, for example a fluorescently labeled secondary antibody. The secondary antibody can be to any combination of one or more isotypes, including but not limited to IgG1, IgG2, IgG3, IgG4, IgA1, IgA2, IgD, IgM, and IgE. The level of fluorescence indicates the amount and/or affinity of the antibody to the FS peptide. We have shown that the relative binding correlates to protection (FIG. 11). The assay may be optimized to selectively detect high affinity binding of antibodies to their cognate FS antigen. The reactivity can be compared to the reactivity seen in healthy people without cancer or to a previous baseline blood sample of that same patient. The readout is the antibody response to particular FS peptides. A positive response indicates that the peptide must be made in that tumor and that the immune system has reacted to it. Sequencing the DNA or RNA from the tumor does not convey either of these important pieces of information. Sequence analysis of the negative IgG reactive FSPs showed that these FSPs contain more pathogen epitopes (FIG. 12). So it is also contemplated that the frequently contacting different pathogen in regular life induces the tolerance to these epitopes and consequently, decreases the effective immune responses to the FPSs containing these epitopes. The approach disclosed herein gives a direct readout of the antibody response to the FS peptides, which is important information in designing a vaccine. Antibody binding to a FS peptide could also be detected by any number of label-free methods.

Accordingly, in some embodiments, selecting candidate FSPs for a personalized cancer vaccine herein, comprises determining the sequence similarity to known pathogen epitopes and selecting FSPs that do not show sequence similarity to known pathogen epitopes. Known pathogen epitopes comprise peptides catalogued in the Immune Epitope Database (IEDB, available on the internet at iedb.org). In some cases, candidate FSPs are searched via a BLAST algorithm against pathogen epitopes in the IEDB. In some embodiments, a candidate FSP is selected for having a BLAST e value less than 10,000.

A T-cell response, in some embodiments, is important for killing cancer cells. Since the FS peptides are generally 8 aa or longer, it is very likely that a FS peptide will have a region that would bind to the patient's MHC to initiate an immune response. JMHC binding can be predicted from commonly available algorithms. Alternatively, the blood sample from the patient could be screened for T-cell activity to the peptide candidates using a T cell assay, such as a proliferation assay, a cytokine assay, a cytotoxicity assay, a degranulation assay, flow cytometry, or combination thereof.

Methods of designing personalized cancer vaccines disclosed herein would not only provide much more relevant information for making a vaccine, but it would have benefits over the existing methods such as simplicity and cost efficacy. It would not require a biopsy of the tumor with the inherent cost, discomfort and danger. The assay itself would be simpler, less expensive and faster than deep sequencing the tumor DNA. The mutations identified in the DNA are most likely to be the result of point mutations which have a low probability of being produced by a patient, or at least immunogenic. Current sequencing protocols are very poor at identifying insertions/deletions in microsatellites or mis-splicing events. The best source of peptides (FS) would be missed by current sequencing protocols. Sequencing a biopsy will only identify mutations in that part of the tumor and mutations in other parts will be missed. By methods disclosed herein, all immune reactive parts of the tumor will be identified. The identification of vaccine components by sequencing will require the application of proprietary algorithms and other assays to identify potentially produced and immunogenic peptides. In contrast, this information is directly readout from our assay. While the broadest application may be for cancer, the same procedure would apply for a vaccine against other chronic diseases. Vaccines based on the MS FS herein also could eliminate cells that are not tumors but are aberrant for other reasons. Such aberrant, dysfunctional cells play a role in diseases such as diabetes, Alzheimer's disease, aging, autoimmune disease, chronic infections, and other diseases.

Microsatellite and Splicing FS Variants

Methods herein, in some embodiments, comprise methods of frameshift variant development for inclusion in personal cancer vaccine development. Frameshift variants, as referred to herein, are alterations in an mRNA caused by errors in transcription, causing an insertion or deletion (INDEL) of one or two nucleotides in the mRNA or by mis-splicing of RNA resulting in a change in the amino acids of the resulting protein that are encoded after the frameshift variant. Methods of frameshift variant development herein include but are not limited to mRNA sequencing and array based hybridization. In some embodiments, frameshift peptides are developed by bioinformatics analysis of already available sequence data. FS variants peptides due to INDELs in MS can be directly inferred from the genome sequence data. Any INDEL in a coding sequence will produce FS if expressed. On the other hand a specific exon mis-splicing may or may not be produced. Therefore, this application focuses on the MS FS, all of which will be produced.

In some embodiments, mRNA sequencing for development of frameshift variants herein includes a method where mRNA from a tumor or cancer tissue is sequenced. In some embodiments, mRNA is purified from a tumor or cancer tissue from a patient. In some embodiments, mRNA is isolated from total mRNA from the tumor or cancer tissue. In some embodiments, mRNA is isolated using oligo-dT purification of total RNA In some embodiments, mRNA is targeted for sequencing using an oligo-dT to prime the RNA sample. In some embodiments, the mRNA is amplified before sequencing. In some embodiments, the mRNA is amplified by PCR before sequencing. In an embodiment the mRNA is sequenced by random priming of the cDNA to detect FS sequences. In some embodiments the mRNA is amplified by RT-PCR before sequencing. In some embodiments, mRNA sequencing comprises targeted sequencing of an mRNA having a microsatellite in the transcript. In some embodiments, mRNA is sequenced using at least one technique selected from Sanger sequencing, pyro-sequencing, ion semiconductor sequencing, polony sequencing, sequencing by ligation, nanoball sequencing, and single molecule sequencing.

Variants identified from mRNA sequencing are classified by type of variant. Variants may arise from mutations in DNA or alterations in the RNA during transcription or splicing herein, which include but are not limited to point mutations, silent mutations, insertions, deletions, cis-splicing errors, and trans-splicing errors. Of these, only insertions, deletions, cis-splicing errors, and trans-splicing errors are expected to lead to a frameshift in a protein produced from the mutant mRNA. Confirmed frameshift variants are those that when translated produce a protein with a different amino acid sequence at more than one residue at residues C-terminal to the alteration. Frameshifted polypeptide sequences resulting from frameshift variants are assembled for further analysis.

In some cases frameshift mutations are predicted based on microsatellite location in the genome. As transcripts having a microsatellite are more prone to transcription errors, frameshift polypeptides can be predicted to be resulting from an insertion or a deletion of one or two basepairs. Alternatively, frameshift polypeptides can be predicted by bioinformatics prediction of cis and/or trans splicing errors. A selection of all possible frameshift peptides can be assembled for further analysis.

Peptides from Frameshifts from MS Indels and Mis-Splicing

Frameshifted polypeptide sequences, determined by mRNA sequencing or prediction, are further analyzed to determine immunoreactivity. In some embodiments, immunoreactivity is measured by MHC or HLA binding. In some embodiments, immunoreactivity is measured by antibody binding. In some embodiments, immunoreactivity is measured by T cell activity. In some embodiments, immunoreactivity is measured by antibody binding and T cell activity.

Binding to MHC is required for T cell activity and can be determined by binding assays. Alternatively, in silico methods of MHC binding are used to predict binding of a peptide to a MHC subtype. Data of peptides binding to MHC subtype molecules are used to develop binding prediction algorithms. These algorithms calculate scoring matrices that quantify the contribution of each residue in a fixed-length peptide to binding to an MHC molecule. Algorithms predict binding of a peptide to class I MHC or class II MHC. Algorithms to predict class I MHC binding include but are not limited to Artificial neural network (ANN), Stabilized matrix method (SMM), SMM with a Peptide:MHC Binding Energy Covariance matrix (SMMPMBEC), Scoring Matrices derived from Combinatorial Peptide Libraries (Comblib_Sidney 2008), Consensus, NetMHCpan, NetMHCcons and PickPocket. Algorithms to predict class II MHC binding, include but are not limited to Consensus method, Combinatorial library, NN-align (netMHCII-2.2), SMM-align (netMHCII-1.1), SturniO10, and NetMHCIIpan. The entire population of frameshift polypeptides is then scanned using one or more of the above algorithms for peptides binding to an MHC subtype molecule with a predicted affinity of IC50<500 nM.

Identifying Frameshift Peptide Antibody Response

Candidate frameshift peptides for personalized cancer vaccines, in some embodiments, are screened for antibody reactivity in an individual needing treatment using a personalized cancer vaccine. Antibody reactivity is determined using an assay for antibody binding to a peptide. In some embodiments, peptides for antibody screening are bound to a substrate, such as a plate, a glass slide, a bead, or other substrate. Assays for antibody binding include but are not limited to ELISA, radio-immuno assay, western blot, surface plasmon resonance, immunostaining, immunoprecipitation, mass spectrometry, phage display, flow cytometry, cytometric bead array, immunohistochemistry, high density array, microarray, and combinations thereof.

In an exemplary embodiment, a blood sample is obtained from an individual needing treatment for breast cancer. The blood sample is diluted in an appropriate buffer and applied to a peptide microarray spotted with vaccine candidate frameshift peptides. The diluted blood sample is incubated with the peptide microarray overnight and the peptide microarray is then washed and exposed to a secondary antibody that binds to canine IgG bound to the microarray. The secondary antibody is conjugated with Alexa Fluor 488 and the microarray is analyzed for fluorescence at each peptide spot. The peptides bound to the individual's antibodies are deemed immunoreactive and selected for the individual's personalized cancer vaccine.

In another exemplary embodiment, an individual is given an intradermal injection of each candidate peptide in a pre-determined pattern on the patient's back to measure delayed-type hypersensitivity (DTH) response. Erythema and induration are measured at 24, 48, and 72 hours. The peptides which elicit a DTH response are deemed immunoreactive and selected for the individual's personalized cancer vaccine.

Identifying Frameshift Peptide T Cell Response

In some embodiments, candidate frameshift peptides are screened for T cell activity in cells obtained from an individual needing treatment using a personalized cancer vaccine. T cell activity is determined using a T cell assay measuring proliferation, cytokine secretion, cytotoxicity, or degranulation in response to a frameshift peptide bound to an antigen presenting cell. T cell assays include but are not limited to proliferation assay, 3H-thymidine assay, BrdU assay, CFSE assay, cytokine secretion assay, ELISA assay, ELISPOT assay, intracellular staining assay, quantitative rtPCR assay, cytometric bead array assay, MHC-tetramer binding assay, cytotoxicity assay, 51-chromium assay, degranulation assay, granulysin assay, granzyme A assay, granzyme B assay, and perforin assay.

In an exemplary embodiment, a blood sample is obtained from an individual needing treatment for breast cancer. PBMCs are isolated from the blood sample and the PBMCs are cultured to expand T cells in the sample and the T cells are incubated in culture media containing one or more candidate peptides for a cytokine release assay. The production of IFN-γ is analyzed in ELISPOT assays. Flat-bottom 96-well nitrocellulose plates are prepared and coated with either anti-canine IFN-γ. Cells were then incubated at a density of $1 \times 10^5$/well either with peptide pools or individual peptides (10 μg/ml), PHA (10 μg/ml), or medium (containing 1% DMSO corresponding to the percentage of DMSO in the pools/peptides) as a control. After 24 hours, cells are removed, and plates are incubated with HRP-conjugated anti-canine IFN-γ Ab (Clone 7-B6-1, Mabtech) at 37° C. After 2 hours, spots corresponding to the HRP-conjugated Ab (IFN-7) are developed with 3-amino-9-ethylcarvazole solution (Sigma-Aldrich, St. Louis, Mo.). Spots are counted by computer-assisted image analysis (Zeiss, KS-ELISPOT reader, Munich, Germany). Each assay is performed in triplicate. The level of statistical significance is determined with a Student's t-test using the mean of triplicate values of the response against relevant pools or individual peptides versus the response against the DMSO control. Criteria for peptide pool positivity are 100 spot-forming cells (SFCs)/ $10^6$ PBMC, p≤0.05 and a stimulation index (SI)≥2, while criteria for individual peptide positivity are ≥20 SFC/$10^6$ PBMC, p≤0.05, and a SI≤2.

Platforms for Screening Peptides for Personalized Cancer Vaccines

In some embodiments, disclosed herein are array platforms that allow for development of peptides suitable for personalized cancer vaccines. The array platforms comprise a plurality of individual features on the surface of the array. Each feature typically comprises a plurality of individual peptides synthesized in situ on the surface of the array or spotted on the surface, wherein the molecules are identical within a feature, but the sequence or identity of the molecules differ between features. Such array molecules include the synthesis of large synthetic peptide arrays.

The peptide arrays can include control sequences that match epitopes of well characterized monoclonal antibodies (mAbs). Binding patterns to control sequences and to library peptides can be measured to qualify the arrays and the assay process. Additionally, inter wafer signal precision can be determined by testing sample replicates e.g. plasma samples, on arrays from different wafers and calculating the coefficients of variation (CV) for all library peptides. Precision of the measurements of binding signals can be determined as an aggregate of the inter-array, inter-slide, inter-wafer and inter-day variations made on arrays synthesized on wafers of the same batch (within wafer batches). Additionally, precision of measurements can be determined for arrays on wafers of different batches (between wafer batches). In some embodiments, measurements of binding signals can be made within and/or between wafer batches with a precision varying less than 5%, less than 10%, less than 15%, less than 20%, less than 25%, or less than 30%.

The technologies disclosed herein include a photolithographic array synthesis platform that merges semiconductor manufacturing processes and combinatorial chemical synthesis to produce array-based libraries on silicon wafers. By utilizing the tremendous advancements in photolithographic feature patterning, the array synthesis platform is highly-scalable and capable of producing combinatorial peptide libraries with 40 million features on an 8-inch wafer. Photolithographic array synthesis is performed using semiconductor wafer production equipment in a class 10,000 cleanroom to achieve high reproducibility. When the wafer is diced into standard microscope slide dimensions, each slide contains more than 3 million distinct chemical entities. Maskless photolithography can also be used to create peptides arrays.

In some embodiments, arrays with peptide libraries produced by photolithographic technologies disclosed herein are used for immune-based assays. Using a patient's antibody repertoire from a biological sample bound to the arrays, a fluorescence binding profile image of the bound array provides sufficient information to classify which peptides are reactive with an antibody from the patient.

Platforms disclosed herein comprise a selection of frameshift peptides disclosed herein, such as peptides resulting from an insertion or deletion error in transcription of an mRNA or peptides resulting from a splicing error such as a trans-splicing error or a cis-splicing error. In some embodiments, platforms herein comprise frameshift peptides comprise peptides having a sequence selected from all MS FS or MS FS from oncogenes, essential genes, highly expressed genes, such as the peptides provided in SEQ ID NO: 1-10665.

In some embodiments, the array is a wafer-based, photolithographic, in situ peptide array produced using reusable masks and automation to obtain arrays of scalable numbers of combinatorial sequence peptides. In some embodiments, the peptide array comprises about 100, about 500, about 1000, about 2000, about 3000, about 4000, about 5,000, about 6000, about 7000, about 8000, about 9000, about 10,000, about 15,000, about 20,000, about 30,000, about 40,000, about 50,000, about 100,000, about 200,000, about 300,000, about 400,000, about 500,000, or more peptides having different sequences. Multiple copies of each of the different sequence peptides can be situated on the wafer at addressable locations known as features.

In some embodiments, the array is a glass slide or nitrocellulose membrane having in vitro synthesized peptides spotted in a predetermined pattern and screened for binding of antibodies in a biological sample from a patient.

In some embodiments, detection of antibody binding on a peptide array poses some challenges that can be addressed by the technologies disclosed herein. Accordingly, in some embodiments, the arrays and methods disclosed herein utilize specific coatings and functional group densities on the surface of the array that can tmle the desired properties necessary for performing assays. For example, non-specific antibody binding on a peptide array may be minimized by coating the silicon surface with a moderately hydrophilic monolayer polyethylene glycol (PEG), polyvinyl alcoHO1, carboxymethyl dextran, and combinations thereof. In some embodiments, the hydrophilic monolayer is homogeneous. Second, synthesized peptides are linked to the silicon surface using a spacer that moves the peptide away from the surface so that the peptide is presented to the antibody in an unhindered orientation.

Platforms herein are also contemplated to include peptides in microtiter plates for determining T cell activity in response to frameshift peptides herein. In some embodiments, microtiter plates include but are not limited to 96 well, 384 well, 1536 well, 3456 well, and 9600 well plates. In some embodiments, more than one peptide is present in each well of a microtiter plate, i.e., the peptides are pooled and individual peptides eliciting T cell activity are determined by deconvolution of the positive and negative wells in the T cell assay.

Screening for Immunogenic Peptides

Optionally, it is useful to determine immunogenicity of a candidate frameshift peptide for use in a personalized cancer vaccine. Immunogenicity, as used herein, refers to the ability of a substance, such as a peptide, to elicit an immune response, such as an antibody response or a T cell response, when administered to an individual, for example, in a vaccine formulation. For individuals, such as dogs, with cancer it is the immune response to the tumor. In some embodiments, a peptide that reacts with an antibody or elicits T cell activity in a biological sample from an individual is not immunogenic when administered in a vaccine formulation. In some embodiments, a peptide that reacts with an antibody or elicits T cell activity in a biological sample from an individual is immunogenic when administered in a vaccine formulation. Immunogenicity is determined by methods of those of skill in the art including in animal model testing and using in silico prediction of immunogenicity. In silico immunogenicity prediction tools are available for free to the public, for example at the Immune Epitope Database and Analysis Resource (www.iedb.org).

Alternatively, mice, such as mice transgenic for canine HLA genes are used to determine the immunogenicity of a candidate frameshift peptide. The candidate frameshift peptide is administered to the transgenic mouse in a vaccine formulation. Response to the vaccine is determined using antibody assays and/or T cell assays described elsewhere herein. In the case of mice that are injected with a tumor or are transgenic to develop tumors, the protection of the frameshift peptide as a vaccine can be determined.

Methods of Designing a Personalized Vaccine

Provided herein are methods of designing a personalized vaccine for an individual, the method comprising, a) obtaining a biological sample from the individual; b) determining immunoreactivity of the biological sample to a first population of peptides; c) preparing a vaccine composition comprising a second population of peptides that have immunoreactivity with the biological sample from the individual, wherein the second population of peptides is a sub-population of the first population. In some embodiments, the biological sample is selected from the group consisting of blood, plasma, serum, thymus, bone marrow, spleen, lymph node, bronchoalveolar lavage, breast, central nervous system, cerebrospinal fluid, eye, tears, gastrointestinal tract, saliva, feces, urine, heart, kidney, liver, lung, muscle, pancreas, peripheral nervous system, saliva, skin, thyroid, trachea, and tumor. In some embodiments, the biological sample is blood, serum, plasma, or saliva. In some embodiments, the biological sample comprises cells selected from B cells, T cells, CD4+ T cells, CD8+ T cells, Th17 cells, and combinations thereof. In some embodiments, the biological sample comprises an antibody.

Methods herein comprise administration of one or more immunoreactive polypeptides reactive to immune cells and antibodies, for example from an individual with cancer. In some embodiments, immunoreactivity comprises antibody reactivity. In some embodiments, immunoreactivity comprises a T cell response. A T cell response herein includes but is not limited to one or more of proliferation assay, 3H-thymidine assay, BrdU assay, CFSE assay, cytokine secretion assay, ELISA assay, ELISPOT assay, intracellular staining assay, quantitative rtPCR assay, cytometric bead array assay, cytotoxicity assay, 51-chromium assay, degranulation assay, granulysin assay, granzyme A assay, granzyme B assay, and perforin assay. Methods herein, in some embodiments, screen a first population for peptides binding to antibodies or eliciting a T cell reaction in a biological sample from an individual, wherein the first population of peptides comprises peptides encoded by a frameshifted mRNA expressed by a cancer cell. In some embodiments, the first population of peptides comprises peptides having a sequence selected from the peptides provided in SEQ ID NO: 1-10665. In some embodiments, each of the first population of peptides binds to at least one MHC subtype. In some embodiments, a portion of the first population of peptides binds to more than one MHC subtype. In some embodiments, each of the first population of peptides binds to at least on HLA subtype. In some embodiments, each of the first population of peptides comprises at least one T cell epitope. In some embodiments, at least one of the first population of peptides comprises at least one T cell epitope. In some embodiments, each of the first population of peptides comprises at least on B cell epitope. In some embodiments, at least one of the first population of peptides comprises at least on B cell epitope. In some embodiments, first population of peptides is bound to a substrate.

Vaccine Compositions and Formulations

Personalized cancer vaccines herein comprise one or more peptides determined to have immunoreactivity with a biological sample from an individual in need of treatment for cancer. For example, personalized cancer vaccines, in some embodiments, comprise 1, 2, 3, 4, 5, 6, 7, 8, 9, 10, 11, 12, 13, 14, 15, 16, 17, 18, 19, 20, or more frameshift peptides determined to have immunoreactivity with a sample from an individual in need of treatment for cancer. In some embodiments, peptides for personalized cancer vaccines are selected from the peptides provided in SEQ ID NO: 1-10665.

In some embodiments, the vaccine can consist of plasmids encoding the MS FS variants. DNA or Gene Vaccines consist of a plasmid with a promoter and appropriate transcription and translation control elements. The plasmids may also sequences that encode peptide or protein fusions to the FS peptide to enhance, for example, expression levels, intracellular targeting or proteasomal processing. For example the LAMP sequence when fused to a FS peptide sequence will enhance MHCII responses. In additional aspects, personalized cancer vaccines herein comprise one or more nucleic acids encoding peptides determined to have immunoreactivity with a biological sample. For example, in some embodiments, personalized cancer vaccines comprise one or more nucleotides encoding 1, 2, 3, 4, 5, 6, 7, 8, 9, 10, 11, 12, 13, 14, 15, 16, 17, 18, 19, 20, or more FS peptides determined to have immunoreactivity with a sample. In some embodiments, nucleotides encode peptides for personalized cancer vaccines selected from the peptides provided in SEQ IDNO: 1-10665. These plasmids can be introduced by a needle, a gene gun, an aerosol injector, with patches, via microneedles, by abrasion among many forms. In some forms the DNA vaccine is incorporated into liposomes or other forms of nanobodies. They may also be administered by inhalation or ingestion. The plasmid can be introduced into the blood, the thymus, the pancreas, the skin, the muscle, a tumor or other sites.

Alternatively or in combination, the peptides can be encoded in RNA that is directly introduced into the individual, such as a dog. The RNA can be chemically synthesized or more commonly in vitro transcribed. The RNA will encode one or more FS peptides and will include signals to enhance stability and translation. The RNA may also include unnatural nucleotides to increase the half-life. These RNAs can be introduced by a needle, a gene gun, an aerosol injector, with patches, via microneedles, by abrasion among many forms. In some forms the RNA is incorporated into liposomes or other forms of nanobodies. They may also be administered by inhalation or ingestion. The RNA can be introduced into the blood, the thymus, the pancreas, the skin, the muscle, a tumor or other sites Alternatively or in combination, the peptides coding sequences can be introduced into a virus as a vector. The peptide encoding sequences can be fused to other sequences that enhance transcription, translation or presentation to the immune system. These viral vectors include pox viruses, adenovirus, lentiviruses, retroviruses, alpha viruses and others using a needle, a gene gun, an aerosol injector, with patches, via microneedles, by abrasion among many forms. They may also be administered by inhalation or ingestion.

Alternatively or in combination, the peptides can be administered via a bacterial vector. The FS coding sequences are introduced into the bacteria, usually in the form of plasmid or lysogenic phage, and the bacteria administered to the patient. Listeria is commonly used in this way, but other bacteria could be used or developed. The bacteria can be administered by needle to the blood or intraperitoneal injection.

Bacteria can Also be Administered Orally.

The peptides can also be delivered as peptides. Usually the peptides are 10aa long or longer, preferably 25aa or longer. 25-40aa long may be ideal. Usually the peptides are fused to a carrier such as albumin, keyhole limpet protein etc. In some forms the peptides are incorporated into liposomes or other forms of nanobodies.

Personalized vaccine formulations herein comprise a personalized vaccine composition in a biologically acceptable formulation, gaseous, liquid or solid, or mixture thereof, which are suitable for one or more routes of administration, in vivo delivery or contact. Such formulations include solvents (aqueous or non-aqueous), solutions (aqueous or non-aqueous), emulsions (e.g., oil-in-water or water-in-oil), suspensions, syrups, elixirs, dispersion and suspension media, coatings, isotonic and absorption promoting or delaying agents, compatible with pharmaceutical administration or in vivo contact or delivery. Aqueous and non-aqueous solvents, solutions and suspensions may include suspending agents and thickening agents. Such pharmaceutically acceptable carriers include tablets (coated or uncoated), capsules (hard or soft), microbeads, powder, granules and crystals. Supplementary active compounds (e.g., preservatives, antibacteRIA1, antiviral and antifungal agents) can also be incorporated into the compositions.

To increase an immune response and efficacy in treating cancer, peptides herein are optionally coupled to another protein such as ovalbumin or keyhole limpet hemocyanin (KLH), thyroglobulin or a toxin such as tetanus or cholera toxin. Peptides herein are also mixed with adjuvants or checkpoint inhibitors.

Adjuvants include, for example: ABM2, AS01B, AS02, AS02A, Adjumer, Adjuvax, Algammulin, Alum, Aluminum phosphate, Aluminum potassium sulfate, *Bordetella pertussis*, Calcitriol, Chitosan, Cholera toxin, CpG, Dibutyl phthalate, Dimethyldioctadecylammonium bromide (DDA), Freund's adjuvant, Freund's complete, Freund's incomplete (IFA), GM-CSF, GMDP, Gamma Inulin, Glycerol, HBSS (Hank's Balanced Salt Solution), IL-12, IL-2, Imiquimod, Interferon-Gamma, ISCOM, Lipid Core Peptide (LCP), Lipofectin, Lipopolysaccharide (LPS), Liposomes, MF59, MLP+TDM, Monophosphoryl lipid A, Montanide IMS- 1313, Montanide ISA 206, Montanide ISA 720, Montanide ISA-51, Montanide ISA-50, nor-MDP, Oil-in-water emulsion, P1005 (non-ionic copolymer), Pam3Cys (lipoprotein), Pertussis toxin, Poloxamer, QS21, RaLPS, Ribi, Saponin, Seppic ISA 720, Soybean Oil, Squalene, Syntex Adjuvant Formulation (SAF), Synthetic polynucleotides (poly IC/poly AU), TiterMax Tomatine, Vaxfectin, XtendIII, and Zymosan.

Checkpoint inhibitors are inhibitors of proteins known to potentiate or inhibit an immune response and accordingly a checkpoint inhibitor increases the immune response. In some instances, tumors are known to upregulate checkpoint inhibitors to evade the immune response in a patient and checkpoint inhibitors allow the immune system of the patient to recognize and eliminate the tumor. Checkpoint inhibitors herein include but are not limited to a PD-1 inhibitor, a PD-L1 inhibitor, a CTLA-4 inhibitor, Pembrolizumab, Nivolumab, or Atezolizumab. They may be administered systemically or locally as an adjuvant.

Cosolvents may be added to a frameshift peptide composition or formulation. Non-limiting examples of cosolvents contain hydroxyl groups or other polar groups, for example, alcohols, such as isopropyl alcohol; glycols, such as propylene glycol, polyethyleneglycol, polypropylene glycol, glycol ether; glycerol; polyoxyethylene alcohols and polyoxyethylene fatty acid esters. Non-limiting examples of cosolvents contain hydroxyl groups or other polar groups, for example, alcohols, such as isopropyl alcohol; glycols, such as propylene glycol, polyethyleneglycol, polypropylene glycol, glycol ether; glycerol; polyoxyethylene alcohols and polyoxyethylene fatty acid esters.

Supplementary compounds (e.g., preservatives, antioxidants, antimicrobial agents including biocides and biostats such as antibacterial, antiviral and antifungal agents) can also be incorporated into the compositions. Pharmaceutical compositions may therefore include preservatives, anti-oxidants and antimicrobial agents.

Preservatives can be used to inhibit microbial growth or increase stability of ingredients thereby prolonging the shelf life of the pharmaceutical formulation. Suitable preservatives are known in the art and include, for example, EDTA, EGTA, benzalkonium chloride or benzoic acid or benzoates, such as sodium benzoate. Antioxidants include, for example, ascorbic acid, vitamin A, vitamin E, tocopherols, and similar vitamins or provitamins.

Pharmaceutical compositions can be formulated to be compatible with a particular route of administration. Thus, pharmaceutical compositions include carriers, diluents, or excipients suitable for administration by various routes. Exemplary routes of administration for contact or in vivo delivery which a composition can optionally be formulated include inhalation, respiration, intranasal, intubation, intrapulmonary instillation, oral, buccal, intrapulmonary, intradermal, topical, dermal, parenteral, sublingual, subcutaneous, intravascular, intrathecal, intraarticular, intracavity, transdermal, iontophoretic, intraocular, ophthalmic, optical, intravenous (i.v.), intramuscular, intraglandular, intraorgan, or intralymphatic.

Formulations suitable for parenteral administration include aqueous and non-aqueous solutions, suspensions or emulsions of the active compound, which preparations are typically sterile and can be isotonic with the blood of the intended recipient. Non-limiting illustrative examples include water, saline, dextrose, fructose, ethanol, animal, vegetable or synthetic oils.

Methods of Eliciting an Immune Response

Also provided herein, are methods of eliciting an immune response in an individual having cancer, the methods comprising, a) obtaining a biological sample from the individual; b) determining immunoreactivity of the biological sample to a first population of peptides; c) preparing a vaccine composition comprising a second population of peptides that have immunoreactivity with the biological sample from the individual, wherein the second population of peptides is a sub-population of the first population; and d) administering the vaccine composition to the individual, wherein administering the vaccine composition elicits an immune response in the individual against the cancer.

Methods herein comprise administration of one or more immunoreactive polypeptides reactive to immune cells and antibodies, for example from an individual with cancer. In some embodiments, immunoreactivity comprises antibody reactivity. In some embodiments, immunoreactivity comprises a T cell response. A T cell response herein includes but is not limited to one or more of proliferation assay, 3H-thymidine assay, BrdU assay, CFSE assay, cytokine secretion assay, ELISPOT assay, intracellular staining assay, quantitative rtPCR assay, cytometric bead array assay, cytotoxicity assay, 51-chromium assay, degranulation assay, granulysin assay, granzyme A assay, granzyme B assay, and perforin assay. Methods herein, in some embodiments, screen a first population for peptides binding to antibodies or eliciting a T cell reaction in a biological sample from an individual, wherein the first population of peptides comprises peptides encoded by a frameshifted mRNA expressed by a cancer cell. In some embodiments, the first population of peptides comprises peptides having a sequence selected from the peptides provided in SEQ ID NO: 1-10665. In some embodiments, each of the first population of peptides binds to at least one MHC subtype. In some embodiments, a portion of the first population of peptides binds to more than one MHC subtype. In some embodiments, each of the first population of peptides binds to at least on HLA subtype. In some embodiments, each of the first population of peptides comprises at least one T cell epitope. In some embodiments, at least one of the first population of peptides comprises at least one T cell epitope. In some embodiments, each of the first population of peptides comprises at least on B cell epitope. In some embodiments, at least one of the first population of peptides comprises at least on B cell epitope. In some embodiments, first population of peptides is bound to a substrate.

Methods of Treatment

Provided herein, in some aspects, are methods of treating an individual in need of treatment for a cancer using a personalized cancer vaccine. An "individual" or "patient", used interchangeably herein, refers to a canine, for example a dog. Some such methods comprise, a) obtaining a biological sample from the individual; b) determining immunoreactivity of the biological sample to a first population of peptides; c) preparing a vaccine composition comprising a second population of peptides that have immunoreactivity with the biological sample from the individual, wherein the second population of peptides is a sub-population of the first population; and d) administering the vaccine composition to the individual, wherein administering the vaccine composition elicits an immune response in the individual against the cancer and wherein the cancer in the individual is reduced. In some embodiments, the biological sample is selected from the group consisting of blood, plasma, serum, thymus, bone marrow, spleen, lymph node, bronchoalveolar lavage, breast, central nervous system, cerebrospinal fluid, eye, tears, gastrointestinal tract, saliva, feces, urine, heart, kidney, liver, lung, muscle, pancreas, peripheral nervous system, saliva, skin, thyroid, trachea, and tumor. In some embodiments, the biological sample comprises cells selected from B cells, T cells, CD4+ T cells, CD8+ T cells, Th17 cells, and combinations thereof. In some embodiments, the biological sample comprises an antibody.

Also provided herein, in some aspects, are methods of reducing risk of reoccurrence of cancer in an individual, the methods comprising, a) obtaining a biological sample from the individual; b) determining immunoreactivity of the biological sample to a first population of peptides; c) preparing a vaccine composition comprising a second population of peptides that have immunoreactivity with the biological sample from the individual, wherein the second population of peptides is a sub-population of the first population; and d) administering the vaccine composition to the individual, wherein administering the vaccine composition elicits an immune response in the individual against the cancer and wherein the risk of developing cancer again in the individual is reduced compared to an individual who did not receive the vaccine.

Methods herein comprise administration of one or more polypeptides reactive to immune cells and antibodies, for example in a biological sample from an individual with cancer. In some embodiments, immunoreactivity comprises antibody reactivity. In some embodiments, immunoreactivity comprises a T cell response. A T cell response herein includes but is not limited to one or more of proliferation assay, 3H-thymidine assay, BrdU assay, CFSE assay, cytokine secretion assay, ELISPOT assay, intracellular staining assay, quantitative rtPCR assay, cytometric bead array assay, cytotoxicity assay, 51-chromium assay, degranulation assay, granulysin assay, granzyme A assay, granzyme B assay, and perforin assay. Methods herein, in some embodiments, screen a first population for peptides binding to antibodies or eliciting a T cell reaction in a biological sample from an individual, wherein the first population of peptides comprises peptides encoded by a frameshifted mRNA expressed by a cancer cell. In some embodiments, the first population of peptides comprises peptides having a sequence selected from SEQ ID NO: 1-10665. In some embodiments, each of the first population of peptides binds to at least one MHC subtype. In some embodiments, a portion of the first population of peptides binds to more than one MHC subtype. In some embodiments, each of the first population of peptides binds to at least on HLA subtype. In some embodiments, each of the first population of peptides comprises at least one T cell epitope. In some embodiments, at least one of the first population of peptides comprises at least one T cell epitope. In some embodiments, each of the first population of peptides comprises at least on B cell epitope. In some embodiments, at least one of the first population of peptides comprises at least on B cell epitope. In some embodiments, first population of peptides is bound to a substrate.

Methods herein comprise administration of a vaccine composition to an individual. Vaccine compositions herein, in some embodiments, comprise a pharmaceutically acceptable adjuvant or excipient. In some embodiments, the adjuvant is selected from the group consisting of ABM2, AS01B, AS02, AS02A, Adjumer, Adjuvax, Algammulin, Alum, Aluminum phosphate, Aluminum potassium sulfate, *Bordetella pertussis*, Calcitriol, Chitosan, Cholera toxin, CpG, Dibutyl phthalate, Dimethyldioctadecylammonium bromide (DDA), Freund's adjuvant, Freund's complete, Freund's incomplete (IFA), GM-CSF, GMDP, Gamma Inulin, Glycerol, HBSS (Hank's Balanced Salt Solution), IL-12, IL-2, Imiquimod, Interferon-Gamma, ISCOM, Lipid Core Peptide (LCP), Lipofectin, Lipopolysaccharide (LPS), Liposomes, MF59, MLP+TDM, Monophosphoryl lipid A, Montanide IMS-1313, Montanide ISA 206, Montanide ISA 720, Montanide ISA-51, Montanide ISA-50, nor-MDP, Oil-in-water emulsion, P1005 (non-ionic copolymer), Pam3Cys (lipoprotein), Pertussis toxin, Poloxamer, QS21, RaLPS, Ribi, Saponin, Seppic ISA 720, Soybean Oil, Squalene, Syntex Adjuvant Formulation (SAF), Synthetic polynucleotides (poly IC/poly AU), TiterMax Tomatine, Vaxfectin, XtendIII, and Zymosan. Vaccine compositions herein, in some embodiments, are administered via a route selected from the group consisting of subcutaneous, intradermal, intramuscular, intranasal, intravenous, and sublingual. Individuals in need of administration of a personalized vaccine, in some embodiments are mammals. In some embodiments, the individual is a dog.

Methods herein comprise administration of a personalized vaccine in an individual with cancer. In some embodiments, the cancer comprises Acanthoma, Acinic cell carcinoma, Acoustic neuroma, Acral lentiginous melanoma, Acrospiroma, Acute eosinophilic leukemia, Acute lymphoblastic leukemia, Acute megakaryoblastic leukemia, Acute monocytic leukemia, Acute myeloblastic leukemia with maturation, Acute myeloid dendritic cell leukemia, Acute myeloid leukemia, Acute promyelocytic leukemia, Adamantinoma, Adenocarcinoma, Adenoid cystic carcinoma, Adenoma, Adenomatoid odontogenic tumor, Adrenocortical carcinoma, Adult T-cell leukemia, Aggressive NK-cell leukemia, AIDS-Related Cancers, AIDS-related lymphoma, Alveolar soft part sarcoma, Ameloblastic fibroma, Anal cancer, Anaplastic large cell lymphoma, Anaplastic thyroid cancer, Angioimmunoblastic T-cell lymphoma, Angiomyolipoma, Angiosarcoma, Appendix cancer, Astrocytoma, Atypical teratoid rhabdoid tumor, Basal cell carcinoma, Basal-like carcinoma, B-cell leukemia, B-cell lymphoma, Bellini duct carcinoma, Biliary tract cancer, Bladder cancer, Blastoma, Bone Cancer, Bone tumor, Brain Stem Glioma, Brain Tumor, Breast Cancer, Brenner tumor, Bronchial Tumor, Bronchioloalveolar carcinoma, Brown tumor, Burkitt's lymphoma, Cancer of Unknown Primary Site, Carcinoid Tumor, Carcinoma, Carcinoma in situ, Carcinoma of the penis, Carcinoma of Unknown Primary Site, Carcinosarcoma, Castleman's Disease, Central Nervous System Embryonal Tumor, Cerebellar Astrocytoma, Cerebral Astrocytoma, Cervical Cancer, Cholangiocarcinoma, Chondroma, Chondrosarcoma, Chordoma, Choriocarcinoma, Choroid plexus papilloma, Chronic Lymphocytic Leukemia, Chronic monocytic leukemia, Chronic myelogenous leukemia, Chronic Myeloproliferative Disorder, Chronic neutrophilic leukemia, Clear-cell tumor, Colon Cancer, Colorectal cancer, Craniopharyngioma, Cutaneous T-cell lymphoma, Degos disease, Dermatofibrosarcoma protuberans, Dermoid cyst, Desmoplastic small round cell tumor, Diffuse large B cell lymphoma, Dysembryoplastic neuroepithelial tumor, Embryonal carcinoma, Endodermal sinus tumor, Endometrial cancer, Endometrial Uterine Cancer, Endometrioid tumor, Enteropathy-associated T-cell lymphoma, Ependymoblastoma, Ependymoma, Epithelioid sarcoma, Erythroleukemia, Esophageal cancer, Esthesioneuroblastoma, Ewing Family of Tumor, Ewing Family Sarcoma, Ewing's sarcoma, Extracranial Germ Cell Tumor, Extragonadal Germ Cell Tumor, Extrahepatic Bile Duct Cancer, Extramammary Paget's disease, Fallopian tube cancer, Fetus in fetu, Fibroma, Fibrosarcoma, Follicular lymphoma, Follicular thyroid cancer, Gallbladder Cancer, Gallbladder cancer, Ganglioglioma, Ganglioneuroma, Gastric Cancer, Gastric lymphoma, Gastrointestinal cancer, Gastrointestinal Carcinoid Tumor, Gastrointestinal Stromal Tumor, Gastrointestinal stromal tumor, Germ cell tumor, Germinoma, Gestational choriocarcinoma, Gestational Trophoblastic Tumor, Giant cell tumor of bone, Glioblastoma multiforme, Glioma, Gliomatosis cerebri, Glomus tumor, Glucagonoma, Gonadoblastoma, Granulosa cell tumor, Hairy Cell Leukemia, Hairy cell leukemia, Head and Neck Cancer, Head and neck cancer, Heart cancer, Hemangioblastoma, Hemangiopericytoma, Hemangiosarcoma, Hematological malignancy, Hepatocellular carcinoma, Hepatosplenic T-cell lymphoma, Hereditary breast-ovarian cancer syndrome, Hodgkin Lymphoma, Hodgkin's lymphoma, Hypopharyngeal Cancer, Hypothalamic Glioma, Inflammatory breast cancer, Intraocular Melanoma, Islet cell carcinoma, Islet Cell Tumor, Juvenile myelomonocytic leukemia, Kaposi Sarcoma, Kaposi's sarcoma, Kidney Cancer, Klatskin tumor, Krukenberg tumor, Laryngeal Cancer, Laryngeal cancer, Lentigo maligna melanoma, Leukemia, Lip and Oral Cavity Cancer, Liposarcoma, Lung cancer, Luteoma, Lymphangioma, Lymphangiosarcoma, Lymphoepithelioma, Lymphoid leukemia, Lymphoma, Macroglobulinemia, Malignant Fibrous Histiocytoma, Malignant fibrous histiocytoma, Malignant Fibrous Histiocytoma of Bone, Malignant Glioma, Malignant Mesothelioma, Malignant peripheral nerve sheath tumor, Malignant rhabdoid tumor, Malignant triton tumor, MALT lymphoma, Mantle cell lymphoma, Mast cell leukemia, Mediastinal gem1 cell tumor, Mediastinal tumor, Medullary thyroid cancer, Medulloblastoma, Medulloepithelioma, Melanoma, Meningioma, Merkel Cell Carcinoma, Mesothelioma, Metastatic Squamous Neck Cancer with Occult Primary, Metastatic urothelial carcinoma, Mixed Mullerian tumor, Monocytic leukemia, Mouth Cancer, Mucinous tumor, Multiple Endocrine Neoplasia Syndrome, Multiple myeloma, Mycosis Fungoides, Myelodysplastic Disease, Myelodysplastic Syndromes, Myeloid leukemia, Myeloid sarcoma, Myeloproliferative Disease, Myxoma, Nasal Cavity Cancer, Nasopharyngeal Cancer, Nasopharyngeal carcinoma, Neoplasm, Neurinoma, Neuroblastoma, Neurofibroma, Neuroma, Nodular melanoma, Non-Hodgkin lymphoma, Nonmelanoma Skin Cancer, Non-Small Cell Lung Cancer, Ocular oncology, Oligoastrocytoma, Oligodendroglioma, Oncocytoma, Optic nerve sheath meningioma, Oral cancer, Oropharyngeal Cancer, Osteosarcoma, Ovarian cancer, Ovarian Epithelial Cancer, Ovarian Germ Cell Tumor, Ovarian Low Malignant Potential Tumor, Paget's disease of the breast, Pancoast tumor, Pancreatic cancer, Papillary thyroid cancer, Papillomatosis, Paraganglioma, Paranasal Sinus Cancer, Parathyroid Cancer, Penile Cancer, Perivascular epithelioid cell tumor, Pharyngeal Cancer, Pheochromocytoma, Pineal Parenchymal Tumor of Intermediate Differentiation, Pineoblastoma, Pituicytoma, Pituitary adenoma, Pituitary tumor, Plasma Cell Neoplasm, Pleuropulmonary blastoma, Polyembryoma, Precursor T-lymphoblastic lymphoma, Primary central nervous system lymphoma, Primary effusion lymphoma, Primary Hepatocellular Cancer, Primary Liver Cancer, Primary peritoneal cancer, Primitive neuroectodermal tumor, Prostate cancer, Pseudomyxoma peritonei, Rectal Cancer, Renal cell carcinoma, Respiratory Tract Carcinoma InvoMng the NUT Gene on Chromosome 15, Retinoblastoma, Rhabdomyoma, Rhabdomyosarcoma, Richter's transformation, Sacrococcygeal teratoma, Salivary Gland Cancer, Sarcoma, Schwannomatosis, Sebaceous gland carcinoma, Secondary neoplasm, Seminoma, Serous tumor, Sertoli-Leydig cell tumor, Sex cord-stromal tumor, Sezary Syndrome, Signet ring cell carcinoma, Skin Cancer, Small blue round cell tumor, Small cell carcinoma, Small Cell Lung Cancer, Small cell lymphoma, Small intestine cancer, Soft tissue sarcoma, Somatostatinoma, Soot wart, Spinal Cord Tumor, Spinal tumor, Splenic marginal zone lymphoma, Squamous cell carcinoma, Stomach cancer, Superficial spreading melanoma, Supratentorial Primitive Neuroectodermal Tumor, Surface epithelial-stromal tumor, Synovial sarcoma, T-cell acute lymphoblastic leukemia, T-cell large granular lymphocyte leukemia, T-cell leukemia, T-cell lymphoma, T-cell prolymphocytic leukemia, Teratoma, Terminal lymphatic cancer, Testicular cancer, Thecoma, Throat Cancer, Thymic Carcinoma, Thymoma, Thyroid cancer, Transitional Cell Cancer of Renal PeMs and Ureter, Transitional cell carcinoma, Urachal cancer, Urethral cancer, Urogenital neoplasm, Uterine sarcoma, Uveal melanoma, Vaginal Cancer, Verner Morrison syndrome, Verrucous carcinoma, Visual Pathway Glioma, Vulvar Cancer, Waldenstrom's macroglobulinemia, Warthin's tumor, or Wilms' tumor.

Provided herein, in some aspects, are methods of monitoring treatment of an individual receiving a personalized cancer vaccine. Some such methods comprise, a) obtaining a biological sample from the individual; b) determining immunoreactivity of the biological sample to a first population of peptides; c) comparing immunoreactivity of the biological sample to a previous immunoreactivity in the individual, wherein successful treatment is indicated by reduced immunoreactivity to the first population of peptides. In some embodiments, the biological sample is selected from the group consisting of blood, plasma, serum, thymus, bone marrow, spleen, lymph node, bronchoalveolar lavage, breast, central nervous system, cerebrospinal fluid, eye, tears, gastrointestinal tract, saliva, feces, urine, heart, kidney, liver, lung, muscle, pancreas, peripheral nervous system, saliva, skin, thyroid, trachea, and tumor. In some embodiments, the biological sample comprises cells selected from B cells, T cells, CD4+ T cells, CD8+ T cells, Th17 cells, and combinations thereof. In some embodiments, the biological sample comprises an antibody.

Methods of Diagnosing Cancer

Provided herein, in some aspects, are methods of determining whether an individual has cancer. Some such methods comprise, a) obtaining a biological sample from the individual and b) determining immunoreactivity of the biological sample to a first population of peptides, wherein the individual is determined to have cancer if the sample from the individual is immunoreactive with one or more of the peptides. In some embodiments, the method further comprises treating the individual using a method comprising, a) preparing a vaccine composition comprising a second population of peptides that have immunoreactivity with the biological sample from the individual, wherein the second population of peptides is a sub-population of the first population and b) administering the vaccine composition to the individual, wherein administering the vaccine composition elicits an immune response in the individual against the cancer and wherein the cancer in the individual is reduced. In some embodiments, the biological sample is selected from the group consisting of blood, plasma, serum, thymus, bone marrow, spleen, lymph node, bronchoalveolar lavage, breast, central nervous system, cerebrospinal fluid, eye, tears, gastrointestinal tract, saliva, feces, urine, heart, kidney, liver, lung, muscle, pancreas, peripheral nervous system, saliva, skin, thyroid, trachea, and tumor. In some embodiments, the biological sample comprises cells selected from B cells, T cells, CD4+ T cells, CD8+ T cells, Th17 cells, and combinations thereof. In some embodiments, the biological sample comprises an antibody.

Methods herein comprise determining whether an individual has cancer by determining whether one or more polypeptides reactive to immune cells and antibodies, for example in a biological sample from the individual. In some embodiments, immunoreactivity comprises antibody reactivity. In some embodiments, immunoreactivity comprises a T cell response. A T cell response herein includes but is not limited to one or more of proliferation assay, 3H-thymidine assay, BrdU assay, CFSE assay, cytokine secretion assay, ELISPOT assay, intracellular staining assay, quantitative rtPCR assay, cytometric bead array assay, cytotoxicity assay, 51-chromium assay, degranulation assay, granulysin assay, granzyme A assay, granzyme B assay, and perforin assay. Methods herein, in some embodiments, screen a first population for peptides binding to antibodies or eliciting a T cell reaction in a biological sample from an individual, wherein the first population of peptides comprises peptides encoded by a frameshifted mRNA expressed by a cancer cell. In some embodiments, the first population of peptides comprises peptides having a sequence selected from SEQ ID NO: 1-10665. In some embodiments, each of the first population of peptides binds to at least one MHC subtype. In some embodiments, a portion of the first population of peptides binds to more than one MHC subtype. In some embodiments, each of the first population of peptides binds to at least on HLA subtype. In some embodiments, each of the first population of peptides comprises at least one T cell epitope. In some embodiments, at least one of the first population of peptides comprises at least one T cell epitope. In some embodiments, each of the first population of peptides comprises at least on B cell epitope. In some embodiments, at least one of the first population of peptides comprises at least on B cell epitope. In some embodiments, first population of peptides is bound to a substrate.

Methods herein comprise determining whether an individual has cancer. In some embodiments, the cancer comprises Acanthoina, Acinic cell carcinoma, Acoustic neuroma, Acral lentiginous melanoma, Acrospiroma, Acute eosinophilic leukemia, Acute lymphoblastic leukemia, Acute megakaryoblastic leukemia, Acute monocytic leukemia, Acute myeloblastic leukemia with maturation, Acute myeloid dendritic cell leukemia, Acute myeloid leukemia, Acute promyelocytic leukemia, Adamantinoma, Adenocarcinoma, Adenoid cystic carcinoma, Adenoma, Adenomatoid odontogenic tumor, Adrenocortical carcinoma, Adult T-cell leukemia, Aggressive NK-cell leukemia, AIDS-Related Cancers, AIDS-related lymphoma, Alveolar soft part sarcoma, Ameloblastic fibroma, Anal cancer, Anaplastic large cell lymphoma, Anaplastic thyroid cancer, Angioimmunoblastic T-cell lymphoma, Angiomyolipoma, Angiosarcoma, Appendix cancer, Astrocytoma, Atypical teratoid rhabdoid tumor, Basal cell carcinoma, Basal-like carcinoma, B-cell leukemia, B-cell lymphoma, Bellini duct carcinoma, Biliary tract cancer, Bladder cancer, Blastoma, Bone Cancer, Bone tumor, Brain Stem Glioma, Brain Tumor, Breast Cancer, Brenner tumor, Bronchial Tumor, Bronchioloalveolar carcinoma, Brown tumor, Burkitt's lymphoma, Cancer of Unknown Primary Site, Carcinoid Tumor, Carcinoma, Carcinoma in situ, Carcinoma of the penis, Carcinoma of Unknown Primary Site, Carcinosarcoma, Castleman's Disease, Central Nervous System Embryonal Tumor, Cerebellar Astrocytoma, Cerebral Astrocytoma, Cervical Cancer, Cholangiocarcinoma, Chondroma, Chondrosarcoma, Chordoma, Choriocarcinoma, Choroid plexus papilloma, Chronic Lymphocytic Leukemia, Chronic monocytic leukemia, Chronic myelogenous leukemia, Chronic Myeloproliferative Disorder, Chronic neutrophilic leukemia, Clear-cell tumor, Colon Cancer, Colorectal cancer, Craniopharyngioma, Cutaneous T-cell lymphoma, Degas disease, Dermatofibrosarcoma protuberans, Dermoid cyst, Desmoplastic small round cell tumor, Diffuse large B cell lymphoma, Dysembryoplastic neuroepithelial tumor, Embryonal carcinoma, Endodermal sinus tumor, Endometrial cancer, Endometrial Uterine Cancer, Endometrioid tumor, Enteropathy-associated T-cell lymphoma, Ependymoblastoma, Ependymoma, Epithelioid sarcoma, Erythroleukemia, Esophageal cancer, Esthesioneuroblastoma, Ewing Family of Tumor, Ewing Family Sarcoma, Ewing's sarcoma, Extracranial Germ Cell Tumor, Extragonadal Germ Cell Tumor, Extrahepatic Bile Duct Cancer, Extramammary Paget's disease, Fallopian tube cancer, Fetus in fetu, Fibroma, Fibrosarcoma, Follicular lymphoma, Follicular thyroid cancer, Gallbladder Cancer, Gallbladder cancer, Ganglioglioma, Ganglioneuroma, Gastric Cancer, Gastric lymphoma, Gastrointestinal cancer, Gastrointestinal Carcinoid Tumor, Gastrointestinal Stromal Tumor, Gastrointestinal stromal tumor, Germ cell tumor, Germinoma, Gestational choriocarcinoma, Gestational Trophoblastic Tumor, Giant cell tumor of bone, Glioblastoma multiforme, Glioma, Gliomatosis cerebri, Glomus tumor, Glucagonoma, Gonadoblastoma, Granulosa cell tumor, Hairy Cell Leukemia, Hairy cell leukemia, Head and Neck Cancer, Head and neck cancer, Heart cancer, Hemangioblastoma, Hemangiopericytoma, Hemangiosarcoma, Hematological malignancy, Hepatocellular carcinoma, Hepatosplenic T-cell lymphoma, Hereditary breast-ovarian cancer syndrome, Hodgkin Lymphoma, Hodgkin's lymphoma, Hypopharyngeal Cancer, Hypothalamic Glioma, Inflammatory breast cancer, Intraocular Melanoma, Islet cell carcinoma, Islet Cell Tumor, Juvenile myelomonocytic leukemia, Kaposi Sarcoma, Kaposi's sarcoma, Kidney Cancer, Klatskin tumor, Krukenberg tumor, Laryngeal Cancer, Laryngeal cancer, Lentigo maligna melanoma, Leukemia, Lip and Oral Cavity Cancer, Liposarcoma, Lung cancer, Luteoma, Lymphangioma, Lymphangiosarcoma, Lymphoepithelioma, Lymphoid leukemia, Lymphoma, Macroglobulinemia, Malignant Fibrous Histiocytoma, Malignant fibrous histiocytoma, Malignant Fibrous Histiocytoma of Bone, Malignant Glioma, Malignant Mesothelioma, Malignant peripheral nerve sheath tumor, Malignant rhabdoid tumor, Malignant triton tumor, MALT lymphoma, Mantle cell lymphoma, Mast cell leukemia, Mediastinal germ cell tumor, Mediastinal tumor, Medullary thyroid cancer, Medulloblastoma, Medulloepithelioma, Melanoma, Meningioma, Merkel Cell Carcinoma, Mesothelioma, Metastatic Squamous Neck Cancer with Occult Primary, Metastatic urothelial carcinoma, Mixed Mullerian tumor, Monocytic leukemia, Mouth Cancer, Mucinous tumor, Multiple Endocrine Neoplasia Syndrome, Multiple myeloma, Mycosis Fungoides, Myelodysplastic Disease, Myelodysplastic Syndromes, Myeloid leukemia, Myeloid sarcoma, Myeloproliferative Disease, Myxoma, Nasal Cavity Cancer, Nasopharyngeal Cancer, Nasopharyngeal carcinoma, Neoplasm, Neurinoma, Neuroblastoma, Neurofibroma, Neuroma, Nodular melanoma, Non-Hodgkin lymphoma, Nonmelanoma Skin Cancer, Non-Small Cell Lung Cancer, Ocular oncology, Oligoastrocytoma, Oligodendroglioma, Oncocytoma, Optic nerve sheath meningioma, Oral cancer, Oropharyngeal Cancer, Osteosarcoma, Ovarian cancer, Ovarian Epithelial Cancer, Ovarian Germ Cell Tumor, Ovarian Low Malignant Potential Tumor, Paget's disease of the breast, Pancoast tumor, Pancreatic cancer, Papillary thyroid cancer, Papillomatosis, Paraganglioma, Paranasal Sinus Cancer, Parathyroid Cancer, Penile Cancer, Perivascular epithelioid cell tumor, Pharyngeal Cancer, Pheochromocytoma, Pineal Parenchymal Tumor of Intermediate Differentiation, Pineoblastoma, Pituicytoma, Pituitary adenoma, Pituitary tumor, Plasma Cell Neoplasm, Pleuropulmonary blastoma, Polyembryoma, Precursor T-lymphoblastic lymphoma, Primary central nervous system lymphoma, Primary effusion lymphoma, Primary Hepatocellular Cancer, Primary Liver Cancer, Primary peritoneal cancer, Primitive neuroectodermal tumor, Prostate cancer, Pseudomyxoma peritonei, Rectal Cancer, Renal cell carcinoma, Respiratory Tract Carcinoma InvoMng the NUT Gene on Chromosome 15, Retinoblastoma, Rhabdomyoma, Rhabdomyosarcoma, Richter's transformation, Sacrococcygeal teratoma, Salivary Gland Cancer, Sarcoma, Schwannomatosis, Sebaceous gland carcinoma, Secondary neoplasm, Seminoma, Serous tumor, Sertoli-Leydig cell tumor, Sex cord-stromal tumor, Sezaiy Syndrome, Signet ring cell carcinoma, Skin Cancer, Small blue round cell tumor, Small cell carcinoma, Small Cell Lung Cancer, Small cell lymphoma, Small intestine cancer, Soft tissue sarcoma, Somatostatinoma, Soot wart. Spinal Cord Tumor, Spinal tumor, Splenic marginal zone lymphoma, Squamous cell carcinoma, Stomach cancer, Superficial spreading melanoma, Supratentorial Primitive Neuroectodermal Tumor, Surface epithelial-stromal tumor, Synovial sarcoma, T-cell acute lymphoblastic leukemia, T-cell large granular lymphocyle leukemia, T-cell leukemia, T-cell lymphoma, T-cell prolymphocytic leukemia, Teratoma, Terminal lymphatic cancer, Testicular cancer, Thecoma, Throat Cancer, Thymic Carcinoma, Thymoma, Thyroid cancer, Transitional Cell Cancer of Renal PeMs and Ureter, Transitional cell carcinoma, Urachal cancer, Urethral cancer, Urogenital neoplasm, Uterine sarcoma, Uveal melanoma, Vaginal Cancer, Verner Morrison syndrome, Verrucous carcinoma, Visual Pathway Glioma, Vulvar Cancer, Waldenstrom's macroglobulinemia, Warthin's tumor, or Wilms' tumor.

The following peptides are for use in a personalized cancer vaccine for dogs. NM_001171544.1, SPAG11B, Ins, A_10, ICLLFASERVGI, (SEQIDNO:1); XM_005623762.2, DDX24, Ins, A_10, IGAFPGYCSKGAQKSKDMDA, (SEQIDNO:2); XM_014117090.1, MORN5, Ins, A_10, KCFKRASA, (SEQIDNO:3); XM_014109016.1, ENO4, Del, A_10, KDKSKEGMILSQRNLFCLQNLLNPYSVAAWP, (SEQIDNO:4); XM_005617440.2, SREK1IP1, Ins, A_10, KEKVLFIQFH, (SEQIDNO:5); XM_014116982.1, TTF1, Del, A_10, KERISSIFFLPL, (SEQIDNO:6); XM_014122648.1, SYTL2, Del, A_10, KFWQERKQRN, (SEQIDNO:9); XM_005617440.2, SREK1IP1, Del, A_10, KGKGLIHPVPLKRTLPSKRNKNTRRKKRRKKKRISQKEGNIIKRKKRREKRRSIHPLLI LLRSPKS, (SEQIDNO:10); XM_005627009.1, SMAP1, Ins, A_10, KGREKERKGARKACETSYN, (SEQIDNO:11); XM_014118197.1, AK9, Ins, A_10, KGTKFALSTAQ, (SEQIDNO:12); XM_005638510.2, KIAA0101, Del, A_10, KHVLCHLITQMTKKN, (SEQIDNO:13); XM_014119761.1, LRRIQ1, Del, A_10, KIRHTDTQRDLQVFQLREYLLQ, (SEQIDNO:14); XM_014119762.1, LRRIQ1, Del, A_10, KIRHTDTQRDLQVSCGFLQS, (SEQIDNO:15); XM_014117913.1, ROR2, Del, A_10, KKERKPACSQTVSSPETTTMRTASASLTGGSRVHASLGTPSMWTPSRCRGRLKTESQRPSP, (SEQIDNO:16); XM_014116982.1, TTF1, Ins, A_10, KKGFPASSFFPFEKIRNM, (SEQIDNO:17); XM_014106280.1, LOC100686575, Ins, A_10, KKRIWSHQQE, (SEQIDNO:18); XM_014120850.1, NME8, Del, A_10, KLSRQGTSWKLRTRECSQNNKQGSSIVAKRRSLTFKILSFL, (SEQIDNO:19); XM_005630994.2, TMEM60, Del, A_10, KPGTSLQCYLN, (SEQIDNO:20); XM_014118680.1, PRR27, Del, A_10, KPPITLGILTLIQGHHPIPGFSLLLEPPSTAFLVFP, (SEQIDNO:21); XM_005625148.1, STKLD1, Ins, A_10, KQSKARDKAGGMY, (SEQIDNO:22); XM_014119593.1, EIF2B3, Del, A_10, KQWSSVTSLEWTAQERGCSSWLMKRTWMKSWSLRDPSCRSTQEYISTQALWTPIST A, (SEQIDNO:23); XM_005627009.1, SMAP1, Del, A_10, KRKRKRKKRSQKSL, (SEQIDNO:24); XM_014118197.1, AK9, Del, A_10, KRNKVCLIHCTIAHRL, (SEQIDNO:25); XM_005620751.2, LOC479667, Del, A_10, KRNWPRKQGKRLLTIWLLGKMNELGSEWSTLSEKITLWRPWRSWSYIVICCWLGLA SSS1, (SEQIDNO:26); XM_014117603.1, ZNF207, Del, A_10, KRSNKMILMNTMMTLQLQLHFSHSLFSLNKVISPRWCNQDCHQFQEHQECLQAYLH (SEQIDNO:27); XM_005634282.1, ULK4, Del, A_10, KRTLENAGLFPWLRTQC, (SEQIDNO:28); XM_014119762.1, LRRIQ1, Ins, A_10, KSGTQTLSGIFK, (SEQIDNO:29); XM_014119761.1, LRRIQ1, Ins, A_10, KSGTQTLSGIFKFFN, (SEQIDNO:30); XM_536376.4, HK1, Del, A_10, KSRTRNYQWDSHFLSLVGSPR, (SEQIDNO:31); XM_005623082.2, ANKRD12, Del, A_10, KTKQQTVVTTLSQKKVKIKKRTGK, (SEQIDNO:32); XM_014110095.1, PHACTR4, Del, A_10, KVVINSKRPQKF, (SEQIDNO:33); XM_014110582.1, C35H6orf201, Del, A_10, KWRSLQCQP, (SEQIDNO:34); XM_014106934.1, MACROD2, Ins, A_10, NERVFPCR, (SEQIDNO:35); XM_005615627.2, ECHDC1, Del, A_10, NFNSFLVDPLTFRRKTVALVFLP, (SEQIDNO:36); XM_014110582.1, C35H6orf201, Ins, A_10, NGGASNVNHSCQMVEKIHATHRRPSVSNPEAVRVWAN, (SEQIDNO:37); XM_005620751.2, LOC479667, Ins, A_10, NGTGPESKERDC, (SEQIDNO:38); XM_005632046.2, THUMPD3, Ins, A_10, NKTQKDKSEFK, (SEQIDNO:39); XM_532252.6, SEC63, Del, A_10, NLHLCPYHSQSNRNKSRQMELLGVKLR, (SEQIDNO:40); NM_001171544.1, SPAG11B, Del, A_10, NMPAVCIRTCWY, (SEQIDNO:41); XM_536376.4, HK1, Ins, A_10, NQGQEITSGIHIFFPLSAVQDRRGHPDHLDKEI, (SEQIDNO:43); XM_014122648.1, SYTL2, Ins, A_10, NSGKRGNREIKFKVHTPGVTR, (SEQIDNO:44); XM_014119437.1, CEP290, Ins, A_10, NSPNGSRKRKKSCNFRINHGGLEPN, (SEQIDNO:45); XM_014110220.1, KIAA1524, Del, A_10, NVKGWSRPLKFC, (SEQIDNO:46); XM_005623762.2, DDX24, Del, A_10, NWSLPRVLLQRCPKKQRHGCLKCMTIRQM, (SEQIDNO:47); XM_014120850.1, NME8, Ins, A_10, NYRGRVRLGN, (SEQIDNO:48); XM_014117913.1, ROR2, Ins, A_10, RKKENQHAHRPYLPQRRLP, (SEQIDNO:49); XM_005630994.2, TMEM60, Ins, A_10, SLVPHCNVT, (SEQIDNO:50); XM_005632220.2, RAD18, Ins, A_10, SNKRRRWIYRKAVTCICGTR, (SEQIDNO:51); XM_014118680.1, PRR27, Ins, A_10, SPQLPWES, (SEQIDNO:52); XM_005634064.2, CCDC168, Ins, A_10, TGDIKSNSTAQPTLQISFRPKEGA, (SEQIDNO:53); XM_005624758.2, BCAS3, Ins, A_10, TMPTAQRP, (SEQIDNO:54); XM_848628.4, ISL1, Ins, A_10, TSDFPMCWLRQSNSRSVYSEGFSGFGMACGMFEMCGV, (SEQIDNO:55); XM_005615627.2, ECHDC1, Ins, A_10, TSTVSWWIR, (SEQIDNO:56); XM_532252.6, SEC63, Ins, A_10, TYTCALTTVKATETKAGKWNCWE, (SEQIDNO:57); XM_536179.5, CHD2, Ins, A_11, ILLNLSSESCTF, (SEQIDNO:58); XM_014119273.1, LOC106559736, Ins, A_11, KARGGNVPAERKGRGREPRTERARQRAEL- RAPPPPPRRA, (SEQIDNO:59); XM_014118903.1, LOC102156909, Del, A_11, KDSASTLS, (SEQIDNO:60); XM_014118224.1, MARCKS, Ins, A_11, KEALLLQEVLQAERLLLQEEQEGGGRGGGRGGG-GRARRRPQGRGRRAGRAGAGAA AGAGAGAGAGAGAGGRGRGGRGGGRGGRRAPGG, (SEQIDNO:61); XM_005632295.2, LOC610950, Del, A_11, KEERTLYSMHLFQVPGNILMGTT, (SEQIDNO:62); XM_005636122.2, SBNO1, Ins, A_11, KEKYRSRFYSKCLISIRSWIKTT, (SEQIDNO:63); XM_005640067.2, E2F3, Del, A_11, KHGMTHHLVCSPRSSFSC, (SEQIDNO:65); XM_014115818.1, G2E3, Del, A_11, KLKDYGLIKPIS-GIVP, (SEQIDNO:66); XM_846664.4, SEC62, Del, A_11, KMGKRKSLKRRKLQELPKRRKLRKNSNLSHM-MIKFFWMEMRYLCGSMTQFTLKHL SWD, (SEQIDNO:67); XM_005632295.2, LOC610950, Ins, A_11, KRREPSTQCTYFKSQGTSSWVQPDSHNQPTANCCG, (SEQIDNO:68); XM_014118224.1, MARCKS, Del, A_11, KRSASPSRSPSS, (SEQIDNO:69); XM_005632360.2, LOC102156781, Ins, A_11, KSDEESEDCFGKDAVLQM, (SEQIDNO:70); XM_014112072.1, LOC100688285, Del, A_11, KSFESREPIRFIFTRLKRSGFF, (SEQIDNO:71); XM_014118903.1, LOC102156909, Ins, A_11, KTLPQP-SAEQLCRSS1, (SEQIDNO:72); XM_014118275.1, ENPP3, Ins, A_11, KVNSEEIVRNLSE, (SEQIDNO:73); XM_014111381.1, EFHC2, Del, A_11, KYYPAKT-SEGCASPSGYLCLMIFWDPYCPGLKTAKNK, (SEQIDNO:74); XM_014106804.1, TOPAZ1, Ins, A_11, NKCQIIRERSM, (SEQIDNO:75); XM_005615796.1, ZCCHC6, Ins, A_11, NNTRELWEYPQKR-TICCFQQSLCV, (SEQIDNO:76); XM_014112072.1, LOC100688285, Ins, A_11, SHSSPANQFDLFLHV, (SEQIDNO:77); XM_014111381.1, EFHC2, Ins, A_11, SITQQRHQKA VQVLQVTFV, (SEQIDNO:78); XM_005637891.1, FANK1, Del, A_12, KEVWESHHPQS-LIHLLWAK, (SEQIDNO:79); XM_014106746.1, XRN1, Del, A_12, KGKWITYF, (SEQIDNO:80); XM_014106745.1, XRN1, Ins, A_12, KGNGSLTFENPYI-ATFQ, (SEQIDNO:81); XM_014106746.1, XRN1, Ins, A_12, KGNGSLTFENPYIATFQWL, (SEQIDNO:82); XM_005637891.1, FANK1, Ins, A_12, KKSGNHTILKASSTCCGQSDSSQH, (SEQIDNO:83); XM_014106803.1, ERICH6, Del, A_12, KPKALKLN, (SEQIDNO:84); XM_014116352.1, EFCAB13, Ins, A_12, RIHRCTEISNN, (SEQIDNO:85); XM_014111397.1, ARL13A, Del, A_13, KEEGTISP, (SEQIDNO:86); XM_005638321.2, UBR1, Del, A_13, KEHSGGGISK, (SEQIDNO:87); XM_014117915.1, SVEP1, Del, A_13, KEMHLKEGISELCPLLLLQMQL-SANQAPTHQMGLKRVNRVLWAVISQHLVPRAASC VQKTLHL, (SEQIDNO:88); XM_014109361.1, LTK, Del, A_13, KGTLCAVWG, (SEQIDNO:89); XM_014111397.1, ARL13A, Ins, A-13, KKKEPSAHN, (SEQIDNO:90); XM_014111037.1, HSPE1, Ins, A_13, KPVPEGRAGV, (SEQIDNO:92); XM_014110403.1, LOC102151755, Del, A_13, KTLKVQKD, (SEQIDNO:93); XM_014107150.1, SYCP2, Del, A_13, NLCYLVFCTISVEIKCPPNG-HAGHL, (SEQIDNO:94); XM_014109537.1, KIAA0lOl, Del, A_13, NVRVPTWT, (SEQIDNO:95); XM_014107150.1, SYCP2, Ins, A_13, TCVTWCFVQYLWK, (SEQIDNO:96); XM_014106529.1, LOC102151520, Del, A_14, KKKKAK-STPPVRGTPTSCSRGEAPQH, (SEQIDNO:97); XM_014112055.1, LOC100684352, Del, A_14, KSFES-REPIRFIFTRLKRSGYF, (SEQIDNO:100); XM_014119387.1, LOC102152631, Del, A_14, KSTLGS-WRIPTTL, (SEQIDNO:101); XM_014109494.1, LOC106558056, Del, A_14, KTNTTGFRLLLF-SPCPSVSLLGKQVLRQARPPRPGATSL, (SEQIDNO:102); XM_005641614.1, LOC492038, Del, A_14, KTRRVSTSTSPGF, (SEQIDNO:103); XM_014119387.1, LOC102152631, Ins, A_14, KVLLGPGESQLHFDRV, (SEQIDNO:104); XM_014106529.1, LOC102151520, Ins, A_14, RRKKQRAPHLSEAHPPPAAEEKPRSTDQR, (SEQIDNO:106); XM_014119729.1, MAP9, Ins, A_14, TLICFLYISDPVRV, (SEQIDNO:107); XM_014110590.1, LOC106558261, Ins, A_15, KELQIR-GGSAAAAAAAAATCRLRAVPGGEAETR-GIPGCGCGCGCDSGSGSGHRRLP PSPAPQRT, (SEQIDNO:108); XM_005631118.2, EHF, Ins, A_15, KERKEKKKKEKKKKSWLLARIA1, (SEQIDNO:109); XM_005631118.2, EHF, Del, A_15, KRKKRKEKERKEK-KIVAAGQTRPVSRS, (SEQIDNO:110); XM_014110590.1, LOC106558261, Del, A_15, KRVANTRWVRCGCGCGRRYMSP-PRSSRRRSGDPRDSGLRLRLRLRLRLRLRPPPAP AQPCPAAHLGL, (SEQIDNO:111); XM_014111331.1, VMA21, Del, A_16, KEFHKYSSKKGI, (SEQIDNO:113); XM_005617128.2, BEND7, Del, A_16, KEKEKGGGSFKHQKAAH, (SEQIDNO:114); XM_005617128.2, BEND7, Ins, A_16, KKKKKVVVLSSTRKQLIRLSP, (SEQIDNO:116); XM_014119733.1, LOC102156511, Del, A_16, KLT-NIRKRQVS, (SEQIDNO:117); XM_014111331.1, VMA21, Ins, A_16, KNSTSTPPRRVYKGG, (SEQIDNO:118); XM_014118792.1, ATP10D, Del, A_16, KRKARR-GAGRQSGSSPWMSIWKEELLFSIPSARGFARRWTPR-TRTPVAGASPDYLHT PDLSAFWT, (SEQIDNO:119); XM_005615677.1, LOC102154410, Ins, A_16, SDGKPRF1, (SEQIDNO:120); XM_014106767.1, VEPH1, Ins, A_17, KHCRELTLGIMAPVGRWQHCS, (SEQIDNO:121); XM_005631271.2, LRP4, Del, A_17, KRLKRIPTKPERRLSPSALGKVELEGSGLR-LAKRILLLQSCQNCVHSSALRMEASPAA LSVLVV-GATSRVR, (SEQIDNO:122); XM_014106767.1, VEPH1, Del, A_17, KTLQGTHPWDYGSSGSVAALL-MMKRTPKGVRLMWGAWQRWHRKQMTLPGGSQQ TLHRGGAEILGL, (SEQIDNO:123); NM_001346046.1, KRT73, Ins, A_18, KEKEAHFPAVHLALLFLR-SPFPGKTPVSHLSCSPPCFSSP1, (SEQIDNO:125); XM_005635589.2, LOC102153838, Del, A_19, KRSPT-PASSPPTRW, (SEQIDNO:127); XM_005628326.1, LOC102152757, Del, A_28, KRPTHYLVSPKTLLWKA, (SEQIDNO:128); XM_544109.5, VCPIP1, Ins, A_7, IAG-NGFFHPSFDGQAFAGSKYRAVTI, (SEQIDNO:129); XM_014119817.1, GALNTL5, Ins, A_7, IATANYPRT-PANPKTAYEI, (SEQIDNO:130); XM_534296.5, PCOLCE2, Ins, A_7, IAYNYSTTCYHHVPCNYRFK-THRFPVSTKV, (SEQIDNO:131); XM_005623751.2, BTBD7, Ins, A_7, ICESYITLYVY, (SEQIDNO:132); XM_546553.6, TRPC6, Ins, A_7, ICSSSKLSAAASVHMV, (SEQIDNO:133); XM_005629273.2, SCYL2, Ins, A_7, IDKTGSSCFC1, (SEQIDNO:134); XM_533782.4, DENND6A, Ins, A_7, IEELKDTGF, (SEQIDNO:135); XM_005639100.2, FRAS1, Ins, A_7, IEFGGQSQQ-FARWNRSL, (SEQIDNO:136); XM_005623155.1, CAT-SPERB, Ins, A_7, IEKLLRITS, (SEQIDNO:137); XM_005641884.1, CXHXorf66, Ins, A_7, IEVILPRKVI, (SEQIDNO:138); XM_539103.4, FBXO43, Ins, A_7, IFAAQKVGHIFLSSKWGL, (SEQIDNO:139); XM_005624758.2, BCAS3, Ins, A_7, IFCHKLLSVSRAQHESYCSWEPLACL-CRKQVDSMPSVPWWSLWRQHSVLHCHGH, (SE- QIDNO:140); XM_014114812.1, LOC100684252, Ins, A_7, IFIGGKVVPSRNPFP, (SEQIDNO:141); XM_005623827.1, ZNF839, Ins, A_7, IFKSENTFRTDISTSQV, (SEQIDNO:142); XM_539156.5, FAM91A1, Ins, A_7, IFQKENSS, (SEQIDNO:143); XM_014120092.1, TEX15, Ins, A_7, IFSDGARREHR, (SEQIDNO:144); XM_005638869.2, DNAJC28, Ins, A_7, IFWLFIYRSHDSQPEQNIDR, (SEQIDNO:145); XM_848169.4, KIAA2026, Ins, A_7, IGQMVSSEASCKRIAWYIDTPFK, (SEQIDNO:146); XM_014117490.1, VWA3B, Ins, A_7, IGSSQRSESYCKM, (SEQIDNO:147); XM_005636896.2, CCNT1, Ins, A_7, IGTCHQSSTCLSPSAGITS, (SEQIDNO:148); XM_532882.5, SMC6, Ins, A_7, IGVNSGQRN, (SEQIDNO:149); XM_005618961.2, DDX50, Ins, A_7, IHEIQIRTG, (SEQIDNO:150); XM_848173.4, ZFHX4, Ins, A_7, IHFCLSPFFYYKPHRT, (SEQIDNO:151); XM_003639638.3, POGZ, Ins, A_7, IHPKSLEPEGGFLSPAGRRALHGSLSAVSPSPRPLPCSHPLLPAPGARSL, (SEQIDNO:152); XM_014107422.1, LOC606856, Ins, A_7, IHYLFNSWCWKRQWK, (SEQIDNO:154); XM_014109628.1, UNC13C, Ins, A_7, IIQTQRNRNWNLNRYSYS, (SEQIDNO:156); XM_005634064.2, CCDC168, Ins, A_7, IIRSQKATQPQVCN, (SEQIDNO:157); XM_014107447.1, LOC486036, Ins, A_7, IKSVTLCPHRVLRI, (SEQIDNO:158); XM_005636673.2, SLCO1B3, Ins, A_7, ILYLCTGASLELFFLFIGKHPNYHAGF, (SEQIDNO:159); XM_014110874.1, ERICH2, Ins, A_7, IMSDDPN1, (SEQIDNO:160); XM_005622326.2, LOC609365, Ins, A_7, IMSTSRRTQQWPGSPRR, (SEQIDNO:161); XM_014110545.1, LOC100686395, Ins, A_7, INEYLWISSHCCVHLLWNYNLHVPTTR, (SEQIDNO:162); XM_014117985.1, CNTLN, Ins, A_7, INFSKEEW, (SEQIDNO:163); XM_543280.4, SLC16A14, Ins, A_7, IPGWCPR1, (SEQIDNO:164); XM_532445.5, WAS1, Ins, A_7, IPKSSYRLVGPATKEI, (SEQIDNO:165); XM_005626541.2, CDKL3, Ins, A_7, IPKTKWIVGRYS, (SEQIDNO:166); XM_014120611.1, AP4B1, Ins, A_7, IPPCTNRCACASQGTFAGCLFFREP, (SEQIDNO:167); XM_848523.3, ZNF804A, Ins, A_7, IQAHQEPGGTGHSGREIHHHKVEGYPRTLVP, (SEQIDNO:168); XM_005619526.2, TVP23B, Ins, A_7, IQDQTSSGIIFPFILSSQCNCSLSS1, (SEQIDNO:169); XM_014115688.1, FERMT2, Ins, A_7, IQEQADNSKNLGGPSECSSDESN, (SEQIDNO:170); XM_843555.3, TRIML1, Ins, A_7, IQHGHNSGPSYSQCLPCLV, (SEQIDNO:171); XM_005641806.2, RBMX2, Ins, A_7, IQKRQKGEKEKKERQREH, (SEQIDNO:172); XM_014106331.1, BORA, Ins, A_7, IQLGKYNQPFTSFFTHFLTDRISNRKDSTPGTKEVYFSFS, (SEQIDNO:173); XM_014107769.1, ZNF26, Ins, A_7, IQSEHELDSFKEIKQ, (SEQIDNO:174); XM_003434814.3, ZNF75A, Ins, A_7, IQSELPPY, (SEQIDNO:175); XM_005619062.2, ADK, Ins, A_7, IQSRISCWWLYPEFN, (SEQIDNO:176); XM_532364.5, IREB2, Ins, A_7, IRFRELQRLGCQRTVSAGRESCFG, (SEQIDNO:177); XM_535304.5, CHD9, Ins, A_7, IRRRCRRETI, (SEQIDNO:178); XM_005623020.2, ESCO1, Ins, A_7, IRSKGNCKITG, (SEQIDNO:179); XM_538971.3, FAM83B, Ins, A_7, IRTKNGFIS, (SEQIDNO:180); XM_005630347.2, CEBPZ, Ins, A_7, IRVCFLGAL, (SEQIDNO:181); XM_005636978.2, KIF21A, Ins, A_7, ISEERIDWPSNF, (SEQIDNO:182); XM_005615521.2, CCDC170, Ins, A_7, ISGRSRKERKAAGGLQRGDFQDAGLEHDQSCTS, (SEQIDNO:183); XM_014116465.1, NOS2, Ins, A_7, ISLHAERAYQQVQVCRVWPRLQHVPSVLCLCS, (SEQIDNO:184); XM_005637743.2, PLEKHS1, Ins, A_7, ISRTQTSSFTTRLLVRNY, (SEQIDNO:185); XM_014119368.1, LRBA, Ins, A_7, ISSLTFYTYYKSTYKCCQCGFFSRFNPNLRWRRRITWW, (SEQIDNO:186); XM_846123.4, POLE2, Ins, A_7, ISSSINDQPPCTKFIWNSKG, (SEQIDNO:187); XM_005638907.2, TTC3, Ins, A_7, ISTRKNGRGPKGK, (SEQIDNO:188); XM_014110841.1, CCDC148, Ins, A_7, ISVCLYRA, (SEQIDNO:189); XM_539419.4, RBM48, Ins, A_7, ITGEEGLYSKNY, (SEQIDNO:190); XM_014110823.1, ZNF385B, Ins, A_7, ITVLFTMQSGCELPVTARGTQHRI, (SEQIDNO:191); XM_005629985.2, CFAP97, Ins, A_7, IVGCYNRA, (SEQIDNO:192); XM_014112496.1, KIAA0232, Ins, A_7, IWHGEECSDVPGFSGGISWDSAGGEAESVFGM, (SEQIDNO:193); XM_849077.4, PPAT, Ins, A_7, IWSIVGQL, (SEQIDNO:194); XM_014120510.1, TPRKB, Ins, A_7, IWYLSKRHFSSNCIH, (SEQIDNO:195); XM_014114179.1, DTX2, Ins, A_7, IYGRAENGLR, (SEQIDNO:196); XM_005618061.2, GIN1, Ins, A_7, IYLQRKKAVLCWKRQKTKSFGNCFRRRKKESPKRVP, (SEQIDNO:197); XM_014120145.1, PCMI, Ins, A_7, NPSCYFNPSC, (SEQIDNO:198); XM_014119418.1, CHD8, Ins, A_7, IYRGSGYKDHR, (SEQIDNO:199); XM_014114967.1, ASPM, Ins, A_7, NSCSTSTSAWLVSKKKNFRTKNQNQTSSLHSSCILSPVCS, (SEQIDNO:200); XM_005618961.2, DDX50, Del, A_7, KAAHQRFLFWLLQGNWQTK, (SEQIDNO:201); XM_014118822.1, REST, Del, A_7, KAASLLRKRLLRRSLLRRGL1, (SEQIDNO:203); XM_014121623.1, TRNT1, Del, A_7, KAATKWRKMNSSVTSRRVKI, (SEQIDNO:204); NM_001024633.1, HTR2B, Ins, A_7, KAAVCYQLFSNVPSSG, (SEQIDNO:205); XM_005621312.2, AG1, Ins, A_7, KAAWSPRHENFGSRRYGLLWNL, (SEQIDNO:206); XM_014106867.1, MYBL2, Ins, A_7, KACCPVPCHREQRQPVLPRLL, (SEQIDNO:207); XM_014119192.1, VWDE, Ins, A_7, KACEPKQTGITFTKTSWK, (SEQIDNO:208); XM_005629416.2, STIL, Del, A_7, KACHAFYLVLS, (SEQIDNO:209); XM_532156.6, CDC5L, Ins, A_7, KACTWFLRYF, (SEQIDNO:210); XM_005642075.2, LOC100683955, Del, A_7, KADKAKPGSGTTSRFLKQGAVWICGNGGPVTWPSLLKWMCRNTPEGRGRPDATSP LQGSGQPPR, (SEQIDNO:211); XM_014110764.1, KCNH7, Del, A_7, KADLHLSSPPLMMNKSLSSQE, (SEQIDNO:212); XM_005623023.2, ROCK1, Ins, A_7, KAEGRERSSREG, (SEQIDNO:213); XM_005616873.2, CD3EAP, Ins, A_7, KAEKATAGSCV, (SEQIDNO:214); XM_014115181.1, LOC106559028, Ins, A_7, KAEKNSLHRYIW, (SEQIDNO:215); XM_537461.5, ARID4A, Ins, A_7, KAETENTGTVITREKNKN, (SEQIDNO:216); XM_014108264.1, PPFIBP1, Ins, A_7, KAEVNQIFNGQTF, (SEQIDNO:217); XM_003640002.3, EDRF1, Del, A_7, KAFHVLKKEFTILSQLMMPQMLPFCCVTRGDS, (SEQIDNO:218); XM_014114842.1, KIAA1107, Del, A_7, KAFKKKLI, (SEQIDNO:219); XM_014122448.1, C2CD3, Del, A_7, KAFLGDHLS, (SEQIDNO:220); XM_014114451.1, ZNF471, Del, A_7, KAFPKILW, (SEQIDNO:221); XM_005627613.2, RARS2, Ins, A_7, KAFSASVPNASDHGI, (SEQIDNO:222); XM_014106856.1, PLCB1, Ins, A_7, KAGEDNRS, (SEQIDNO:223); XM_005628737.1, LOC102153873, Ins, A_7, KAGGWSQVLEIWGCCHC, (SEQIDNO:224); XM_535304.5, CHD9, Ins, A_7, KAGKEEECRRC, (SEQIDNO:225); XM_014108788.1, MK167, Ins, A_7, KAGLLWWSSETGVI, (SEQIDNO:226);

XM_005617306.2, DIAPH1, Ins, A_7, KAGLRVNSPT, (SEQIDNO:227); XM_014109172.1, PRKDC, Ins, A_7, KAGPSRGQSR, (SEQIDNO:228); XM_005616994.2, ARHGAP21, Ins, A_7, KAHCYRNVRCQTG, (SEQIDNO:229); XM_014106956.1, ADNP, Ins, A_7, KAHLQMHPLPWCIHQQHDRLDYHSASSSLQRCWKDPEWPG, (SEQIDNO:230); XM_005640932.2, KCTD3, Del, A_7, KAILQVKSTVC, (SEQIDNO:231); XM_534297.5, U2SURP, Del, A_7, KAIWNSSKKN, (SEQIDNO:232); XM_014110541.1, PGBD1, Ins, A_7, KAKAVKCAREELDQKRH, (SEQIDNO:233); XM_536302.5, RASA1, Del, A_7, KAKENGGKIYILS, (SEQIDNO:234); XM_014111707.1, LOC102153942, Del, A_7, KAKKVKQVRILTS, (SEQIDNO:235); XM_005623486.2, SYNE2, Ins, A_7, KALFGYPANKKESG, (SEQIDNO:236); XM_005615387.2, C1H18orf54, Del, A_7, KALHPYFVEERLLMT, (SEQIDNO:237); XM_542589.4, OLFM4, Ins, A_7, KALQPNHPHRDHGKGYHFLHGTGL, (SEQIDNO:238); XM_014122806.1, ZNF214, Ins, A_7, KALQRGHVGELHKCHVSRKLERELQIPRRKIQIFRT, (SEQIDNO:239); XM_005626549.2, JADE2, Ins, A_7, KALRGFPDRPNHSHEDPRLLPTQPG, (SEQIDNO:240); XM_005631042.2, RTN3, Del, A_7, KALRQHKFSLIFLKGVQLVRPHVHKYLT, (SEQIDNO:241); XM_005622426.1, RGL1, Ins, A_7, KALRVFLVVFLYPFHGHHFLRDVVLNQPPLLPSVLQQQPQNPQALRLCDIHYLDSAA SRLQPTERRHLHNPHQCRGQQRQHVQEHRADEPR, (SEQIDNO:242); XM_548044.5, NSF, Del, A_7, KALTPTLTILTRWQQNSFSSSTIRHSQWDSSLCLASMKNFLACW, (SEQIDNO:243); XM_005620768.2, NFAT5, Del, A_7, KALVPDWFLELTSQGKMAP1, (SEQIDNO:244); XM_844360.4, C16H4orf47, Ins, A_7, KAMWFRKLLWNNRWSSAILQCTVKTQRKI, (SEQIDNO:247); XM_844191.4, KCNT2, Del, A_7, KAMYQGHFIMDLLDYLYIA, (SEQIDNO:248); XM_537580.5, CEP112, Ins, A_7, KAPQCCRRNGKGKV, (SEQIDNO:249); XM_545800.5, OCA2, Ins, A_7, KAQDIRQDSAHQMPDGVGICYLHVLSQFICPWCSS, (SEQIDNO:250); XM_014113223.1, DYNC2H1, Del, A_7, KAQLISIF, (SEQIDNO:251); XM_005628249.2, STAP1, Del, A_7, KAQNMLTS, (SEQIDNO:252); XM_014115681.1, RALGAPA1, Ins, A_7, KAQRERSWT, (SEQIDNO:253); XM_533351.4, KIF5C, Ins, A_7, KAQWEALSS, (SEQIDNO:254); XM_860109.5, RBM39, Del, A_7, KARAEVVVMNEKEAKVRNGNEVEIEKGKRAKVAKGSEVGAKKGDGAAQEVEIAD SEAATEVLTDDAPEAKVHSEKTRAP, (SEQIDNO:255); XM_005629880.1, NRG1, Ins, A_7, KAREVRTSH, (SEQIDNO:257); XM_535474.5, USP8, Ins, A_7, KARFQATAGLLSFNTWTRKHQKSY, (SEQIDNO:258); XM_537686.5, COIL, Del, A_7, KARGKTEPRVV, (SEQIDNO:259); XM_546967.5, LOC489848, Ins, A_7, KARHRRERPKGEGQRFGKKLQPEFKL, (SEQIDNO:260); XM_003639390.3, TLN1, Del, A_7, KARIILGWRETRSLLCWRTQFPPKSRQSSSSSITGWGRWSTALWPCLLSCALEPPVLK ISRWAACHQPSSRLPVARCTEDTCPL, (SEQIDNO:261); XM_005628720.1, KIAA0895, Ins, A_7, KASFTKTVFLHLLQKM, (SEQIDNO:262); XM_005626529.2, AFF4, Del, A_7, KASMDQNTPNHALPALENPRLFLH, (SEQIDNO:263); XM_845921.4, ECM1, Ins, A_7, KASSSHGLELS, (SEQIDNO:264); XM_014121388.1, IWS1, Ins, A_7, KASTEKINIITYCGYAP, (SEQIDNO:265); XM_014121139.1, APIP, Del, A_7, KASVLLF1, (SEQIDNO:266); XM_003639956.1, PZP, Ins, A_7, KASVPLCSGFPGLVPIWNTHIHQDWESCTGNHSEFHGICYKFPSG, (SEQIDNO:267); XM_014119282.1, ANKS1B, Del, A_7, KATNLKTIPLLAQEQLGVDPGMGTNG1, (SEQIDNO:268); XM_845166.4, CACNG3, Del, A_7, KATPMAGPFISGPSLSSSQKLWESLPCTSI, (SEQIDNO:269); XM_014120026.1, WHSC1L1, Del, A_7, KATSMTHVDLKSASHTKSPN, (SEQIDNO:270); XM_005618261.2, ZNF518B, Del, A_7, KAVCTHTDRLFLLSP, (SEQIDNO:271); XM_005618061.2, GIN1, Ins, A_7, KAVLCWKRQKTKSFGNCFRRRKKESPKRVP, (SEQIDNO:272); XM_537619.5, GPATCH8, Del, A_7, KAVLPSLRAVSRWQ, (SEQIDNO:273); XM_014110273.1, KIAA1407, Del, A_7, KAWSLGRD, (SEQIDNO:275); XM_014107753.1, LOC106557817, Del, A_7, KCACTLIGRQGICC, (SEQIDNO:276); XM_005626240.1, EML6, Ins, A_7, KCCFQHPDRWAHGRGDLGPGHSPHQGHLHLCQQ, (SEQIDNO:277); XM_005629547.2, AGK, Ins, A_7, KCCPDFTLIWHGCDCC, (SEQIDNO:278); XM_005615542.2, SERAC1, Del, A_7, KCCWKPPRSQK, (SEQIDNO:279); XM_547651.5, THOC1, Ins, A_7, KCCYLEIKYILFCWEKLFTTYVQ, (SEQIDNO:280); XM_847556.4, BRIP1, Ins, A_7, KCDFQIHKPNLQQTNKAS, (SEQIDNO:281); XM_535195.5, ITIH2, Ins, A_7, KCEAAHTRQHLLVQLGDRI, (SEQIDNO:282); XM_014112095.1, LOC102156264, Ins, A_7, KCELIYRLEKQRESSKTSD, (SEQIDNO:283); XM_014119642.1, ZMYM6, Del, A_7, KCFIKGKLHIIRPDLLSSFAPRGASLDILHGSAYHLLPRKPAQTVQKTF, (SEQIDNO:285); XM_014118277.1, ENPP3, Del, A_7, KCGITSTVFF1, (SEQIDNO:286); XM_005622209.2, KDM5B, Del, A_7, KCGPPKRRKSN, (SEQIDNO:287); XM_005619751.1, NXPE4, Ins, A_7, KCHQCLQMQQKNCSSEKEMQVWNDIHNPWWTCLERDMESCLL, (SEQIDNO:289); XM_014121779.1, NISCH, Ins, A_7, KCHSPSGPRNSYLPGPCRPGWATTLVGVPLCREAGK1, (SEQIDNO:290); XM_003640144.3, EIF2B5, Ins, A_7, KCICHDNDLQRVIP, (SEQIDNO:291); XM_849749.4, ST3GAL5, Del, A_7, KCINIWTQTV, (SEQIDNO:292); XM_014117196.1, LOC106559354, Ins, A_7, KCISYKRKAVRF, (SEQIDNO:294); XM_014109138.1, CFAP43, Ins, A_7, KCKDSRNYFRSGLGRSGLATRI, (SEQIDNO:295); XM_005630416.1, BUB1, Ins, A_7, KCKFFWGLGSQ, (SEQIDNO:296); XM_003434003.1, DSPP, Ins, A_7, KCKPGGRSNTRGKWSWQWRRCWPG, (SEQIDNO:298); XM_005623486.2, SYNE2, Ins, A_7, KCLARSLF, (SEQIDNO:299); XM_005633861.2, CAB39L, Del, A_7, KCLCLVNHPKIQQKL, (SEQIDNO:300); XM_005630011.2, WWC2, Del, A_7, KCLEARVAMNLVKPKPF, (SEQIDNO:301); XM_005616987.1, ENKUR, Del, A_7, KCLIGMSPENLLCH, (SEQIDNO:302); XM_005638071.2, ZNF704, Del, A_7, KCLINTCFPWPWRKM, (SEQIDNO:303); XM_534555.5, CEP44, Del, A_7, KCLKKLQSY, (SEQIDNO:304); XM_005619368.2, CARD6, Del, A_7, KCLKMSCHV, (SEQIDNO:305); XM_844363.3, C33H3orf17, Del, A_7, KCLQLLQLKE, (SEQIDNO:306); XM_014109639.1, LONP2, Del, A_7, KCLSQCQNML, (SEQIDNO:307); XM_014110870.1, FSIP2, Del, A_7, KCLTNGKRNQMTWKMKSIS, (SEQIDNO:308); XM_005631810.2, LARP1B, Del, A_7, KCMRNLDNLLGKMQKKITGMD, (SEQIDNO:309); XM_014118978.1, AKAP9, Del, A_7, KCMSSSPK, (SEQIDNO:310); XM_014108087.1, CCDC62, Ins, A_7, KCNCYLICIYKRLTGEAKVLVSGRKNASRT, (SEQIDNO:311); XM_544601.6, ARHGAP11A, Ins, A_7, KCPAFHITHNSYTKC, (SEQIDNO:314); XM_857524.4, TAOK3, Del, A_7, KCPIVGNRHMRNGKIFSRKSSFYNN, (SEQIDNO:315); XM_534136.5, WBP4, Ins, A_7, KCPRAKFIRSK, (SEQIDNO:316); XM_863207.4, SNW1, Del, A_7, KCQMHWPFRWMLKEKLNMMQLLGKDSQKTRSFIASILTWFPRKS, (SEQIDNO:318); XM_014116784.1, SUPT6H, Del, A_7, KCQMTRMTTRRNMAKRNMKKRLLQRKSSRMGKGKKGRKLWRPPWLLQRRRRKM MKNQTSMTLLWMMTDSP, (SEQIDNO:319); XM_003434930.3, SLC30A1, Del, A_7, KCQTNNLNHLC, (SEQIDNO:320); XM_005618730.2, WHAMM, Ins, A_7, KCRCCRRIRNTVL, (SEQIDNO:321); XM_014106804.1, TOPAZ1, Ins, A_7, KCRGVPEAPRVDATP, (SEQIDNO:322); XM_014111503.1, LOC102153069, Del, A_7, KCRGWHCCQ, (SEQIDNO:323); XM_005633661.2, ZNF143, Del, A_7, KCRLSYKDMQQE, (SEQIDNO:324); XM_005640594.2, PIKFYVE, Ins, A_7, KCRPFCSFKGSTCYGKQQTRKQN, (SEQIDNO:325); XM_536013.5, GTF3C3, Ins, A_7, KCRRRNFRRE, (SEQIDNO:326); XM_014122578.1, CEP295, Ins, A_7, KCSFPAFCRKCAEFSLQFL, (SEQIDNO:327); XM_014121376.1, TNIP3, Ins, A_7, KCSHKQEEGTLRM, (SEQIDNO:328); XM_014120929.1, AP2A2, Del, A_7, KCSIPTLRTPCSLRRSA, (SEQIDNO:329); XM_014114455.1, TRMT13, Ins, A_7, KCSREVDPCGWHCYCTLLSPQV, (SEQIDNO:330); XM_544733.5, DENND4A, Del, A_7, KCSRKRWIHLMKCATAFSCSSVGSTISPCLQFECFLKCRKLVLIPMPLLMVIIIRLFWK APGPQEVVVAIFFGQK, (SEQIDNO:331); XM_005640584.2, ZDBF2, Ins, A_7, KCSSGRQKQ, (SEQIDNO:332); XM_535180.5, HSPA14, Ins, A_7, KCSWGSSQSCWV, (SEQIDNO:333); XM_005623470.2, C8H14orf39, Del, A_7, KCTMVIYVSIKMF, (SEQIDNO:334); XM_005628374.2, COPG2, Del, A_7, KCTPSSTLLQSVKEI, (SEQIDNO:335); XM_005632905.2, DNMT1, Del, A_7, KCTRGRKRNRTRIGSLGLEMLSRLMGRRITIRRFASIQKPWKWETVSLLFQMTLQNR CI, (SEQIDNO:336); XM_014111638.1, ZFX, Del, A_7, KCTSVDIVTLRLQIHLF, (SEQIDNO:337); XM_014109263.1, ST18, Ins, A_7, KCVCSDHK, (SEQIDNO:338); XM_014108953.1, ZNF518A, Ins, A_7, KCVIFVSIRIGYSISKFDHKS, (SEQIDNO:339); XM_005628611.2, DNAH11, Del, A_7, KCWKPLVNVLKV, (SEQIDNO:340); XM_005623751.2, BTBD7, Ins, A_7, KCWNICSSSTILSLCGGSKVSAGRDDG, (SEQIDNO:341); XM_014109476.1, STARD9, Del, A_7, KCYTLTPVTSIPTSSPPIQRGLCRLAGSSMCLAVH, (SEQIDNO:342); XM_005616244.2, VSIG10L, Ins, A_7, KDAEHNPSADPTASALQSAAGGP, (SEQIDNO:343); XM_014119604.1, TMPO, Del, A_7, KDAPFPCG, (SEQIDNO:344); XM_005623416.2, SAMD4A, Del, A_7, KDCCHGNSRCRSSFGLSLGKPF, (SEQIDNO:345); XM_855384.3, USP15, Del, A_7, KDC1HSSSTI, (SEQIDNO:346); XM_005639666.2, DNAH5, Del, A_7, KDCPNLITFWIN, (SEQIDNO:347); XM_537432.5, MDGA2, Del, A_7, KDDFGSHQILITKMTTSRLGVR, (SEQIDNO:348); XM_014113138.1, C4H5orf42, Del, A_7, KDEDDELRKSCKKKDQKN, (SEQIDNO:349); XM_005632115.2, CCDC174, Ins, A_7, KDEKVKRRWSRGRK, (SEQIDNO:350); XM_531770.5, GCC2, Ins, A_7, KDEVPSRRECSSV, (SEQIDNO:351); XM_014114846.1, ZNF644, Ins, A_7, KDFHERLCCRIIQKISHLYM, (SEQIDNO:352); XM_014106427.1, EPSTI1, Del, A_7, KDFKKTSEEKHLESTTNTKLLSS, (SEQIDNO:353); XM_539598.4, CLSPN, Ins, A_7, KDGKNQAAKKEGNEK, (SEQIDNO:354); XM_844509.3, NPM2, Ins, A_7, KDGKRRGGSETQA, (SEQIDNO:355); XM_542243.5, ANKRD49, Ins, A_7, KDGKRSKQIASLGC, (SEQIDNO:356); XM_539736.5, IKBIP, Ins, A_7, KDGRLNYSDVQYGRRYAESSI, (SEQIDNO:357); XM_005629238.2, METAP2, Del, A_7, KDGRRRRVKGLPQGNKNLIKNQEPQLMR, (SEQIDNO:358); XM_861061.4, METAP2, Del, A_7, KDGRRRRVKGLPQQGNKNLIKNQEPQLMR, (SEQIDNO:360); XM_005619587.1, PATE2, Del, A_7, KDGVCIFIPNCHV, (SEQIDNO:361); XM_005629420.2, LOC102153096, Ins, A_7, KDHLLYWMFRPILFLFLFGNF, (SEQIDNO:362); XM_005624764.2, PIGW, Del, A_7, KDHMSKTG, (SEQIDNO:363); XM_855384.3, USP15, Del, A_7, KDILMKMPQRILKNMKVWNINLLKNPL, (SEQIDNO:364); XM_005635616.2, CLCN3, Del, A_7, KDILRHMAQTANQDPASIMFN, (SEQIDNO:365); XM_546818.5, CDYL2, Del, A_7, KDIQASPLQEVTGPPRRCLTGLPPVVCRSCR, (SEQIDNO:366); XM_014118170.1, PNISR, Del, A_7, KDIVGVDLQQLKLDGVEVEVTHAE, (SEQIDNO:367); XM_014113670.1, PTPRK, Del, A_7, KDIYVGEDTSALETLGGATILTPTTSSLLKNAKMPWGTPGRR, (SEQIDNO:368); XM_003639701.3, NIFK, Del, A_7, KDKEKAIS, (SEQIDNO:369); XM_005632477.1, LOC484748, Ins, A_7, KDKERERDEERRASTSNSTPSN, (SEQIDNO:370); XM_005626023.2, EIF5B, Del, A_7, KDKKSVSK, (SEQIDNO:371); XM_014108034.1, MYO1H, Del, A_7, KDKQPSDLKPTGVGPWLGRWPKGESGLCGP, (SEQIDNO:372); XM_003432496.2, C1H18orf63, Del, A_7, KDLIITFR, (SEQIDNO:373); XM_544630.4, RTF1, Del, A_7, KDLKSGKN, (SEQIDNO:374); XM_014111172.1, LOC102152583, Del, A_7, KDLRLRIMCTCGRYITQIWDGCALMPPIQRRGTGCDM, (SEQIDNO:375); XM_014109094.1, KIF20B, Del, A_7, KDLYMLVQLSLKMKRKAKKCQRTFQKMKTLEFYKKIIKS, (SEQIDNO:376); XM_849225.4, C5H11orf65, Del, A_7, KDMTMQICQRRKWEHQKILYMEIFLKNQIMLD, (SEQIDNO:377); XM_014113966.1, LOC102156567, Ins, A_7, KDNDSKAVSTGPGTRQAVNL, (SEQIDNO:378); XM_005629009.2, RNF11, Ins, A_7, KDPGVCYLYDGLCLWGPNSISAVHAHLSPGLYR, (SEQIDNO:379); XM_005620334.1, DOCK7, Ins, A_7, KDPGVGICNTPGSCRPQNASDGTPGVCRYNSESGAFGGCPSFSV, (SEQIDNO:380); XM_547161.5, MEFV, Ins, A_7, KDPVVLPEIRVCREEHEVPLRNAAFRNRYLQCSRTHLCSGTCR, (SEQIDNO:381); XM_846278.4, MAP4K5, Del, A_7, KDQLLKDF, (SEQIDNO:382); XM_534762.5, MRPL40, Ins, A_7, KDQTTGES, (SEQIDNO:384); XM_005634064.2, CCDC168, Ins, A_7, KDRKKERENCIKCGPKIYV, (SEQIDNO:386); XM_531828.5, RTN4, Ins, A_7, KDRRKTGPNCNREEF, (SEQIDNO:387); XM_005625106.2, SEC16A, Ins, A_7, KDRSLFARRQEQIDRLG, (SEQIDNO:388); XM_003434330.2, LEMD1, Del, A_7, KDSRLPTLTQKP, (SEQIDNO:390); XM_014121497.1, LOC476151, Ins, A_7, KDSRTGETRDH, (SEQIDNO:391); XM_005615576.2, DSE, Ins, A_7, KDSTESSDLGTERTAHR, (SEQIDNO:392); XM_014108622.1, DYRK4, Del, A_7, KDTRIPRISRWC, (SEQIDNO:393); XM_014118118.1, PHIP, Ins, A_7, KDVKTPAKIRYLYLSILYTYTNSSTKA, (SEQIDNO:394); XM_014120722.1, SYCP1, Ins, A_7, KDVRRKSFARG, (SEQIDNO:396); XM_005623743.2, RPS6KA5, Del, A_7, KDWDVVHVMRMKSKNISFFRK, (SEQIDNO:397); XM_543400.5, NAA25, Del, A_7, KDWRPQRN, (SEQIDNO:398); XM_014122300.1, GTPBP4, Ins, A_7, KEAENSAVQGEEHTGPQDASDG, (SEQIDNO:400); XM_846524.3, ACSL3, Del, A_7, KEAKGIQLC, (SEQIDNO:402); XM_005636136.2, C26H12orf65, Ins, A_7, KEAPERTPGIK, (SEQIDNO:403); XM_536179.5, CHD2, Del, A_7, KEAQQSKYRGFRLT, (SEQIDNO:404); XM_014111405.1, LUZP4, Del, A_7, KECDFKTPIKWS, (SEQIDNO:405); XM_005639728.2, MFN1, Ins, A_7, KECEDSQSAGPCPSYGQRLESWLPCTCILAKGKMCPLER, (SEQIDNO:406); XM_014110764.1, KCNH7, Ins, A_7, KECIPSFFR, (SEQIDNO:407); XM_535547.4, SCAPER, Ins, A_7, KECSRSDCISSCWWINSP, (SEQIDNO:408); XM_005618341.2, AGBL1, Ins, A_7, KECVPLWL, (SEQIDNO:409); XM_005617217.2, SMN, Ins, A_7, KECYHSPEAVESW, (SEQIDNO:410); XM_014108062.1, DENR, Ins, A_7, KEDCTTKSYDSQNS, (SEQIDNO:411); XM_014109172.1, PRKDC, Del, A_7, KEDHGFKK, (SEQIDNO:412); XM_005636081.1, SFSWAP, Ins, A_7, KEEEALTVTDRVQGRVPVGVPKQASHTSAHGPLSQHLSRGESGLQSGALQGSFSGK RRPDLLSNCLLCAEQNNSGPHGQSEGDARCFQEHADQCLL, (SEQIDNO:413); XM_005641516.2, ATRX, Ins, A_7, KEEEGYSHAAKGHHTCRTSSNT, (SEQIDNO:414); XM_535608.5, SDAD1, Ins, A_7, KEEEETRGV, (SEQIDNO:415); XM_005633448.2, RSF1, Del, A_7, KEEEKEKMR, (SEQIDNO:416); XM_535884.5, PAK11P1, Ins, A_7, KEEKKEENI, (SEQIDNO:417); XM_005617440.2, SREK1IP1, Ins, A_7, KEEKKGEAFIHS, (SEQIDNO:418); XM_014113675.1, PTPRK, Ins, A_7, KEELLFLLLLPQAC, (SEQIDNO:419); XM_545078.5, ZBTB11, Del, A_7, KEEQSRTWNGCVNNVEGNSLS, (SEQIDNO:420); XM_014110285.1, PARP9, Ins, A_7, KEESDGRENTWETCELQVVSASSLPV1, (SEQIDNO:421); XM_542610.5, DIS3, Del, A_7, KEESKKGL, (SEQIDNO:422); XM_014119891.1, UBN2, Ins, A_7, KEETLQRFSFSGCHDTKISEREGCIKEGA, (SEQIDNO:423); XM_014115182.1, SUCO, Ins, A_7, KEETLQVQN, (SEQIDNO:424); NM_001038648.1, TMEM57, Ins, A_7, KEEVGRSYCCPGRCICCCI, (SEQIDNO:425); NM_001005869.1, HTR2A, Ins, A_7, KEFKERCQEHR, (SEQIDNO:426); XM_005615489.2, SHPRH, Del, A_7, KEFPSFPSINMSVLYIDMMFSGTGVF, (SEQIDNO:427); XM_005641516.2, ATRX, Del, A_7, KEFQIKKTMILLKMKNTEKKEWIIKGRKI, (SEQIDNO:428); XM_005621999.2, SSX2IP, Ins, A_7, KEFREGKTKLYRSSHSPRIGEKGV, (SEQIDNO:429); XM_005621312.2, AG1, Del, A_7, KEFSLIMKSE, (SEQIDNO:430); XM_541861.5, PARP3, Ins, A_7, KEGAAGCRGGGQLPHCRGPQSCTHREARSPSGPSMPAQPQPSDPGA, (SEQIDNO:431); XM_005626522.2, KIF3A, Del, A_7, KEGAVAAAVVQTPHVLS, (SEQIDNO:432); XM_014117357.1, FAM227A, Ins, A_7, KEGKPHVHPTFKLP, (SEQIDNO:435); XM_005615620.2, RSPO3, Del, A_7, KEGRGKGKNPIRKRVRTQYLTTKVWNPAEKPRNHEKTKTNSSRRSERSKINNRNRL WISFGD, (SEQIDNO:436); XM_005626521.2, KIF3A, Del, A_7, KEGVKRKCPQIRWLKCKQKLMRREKHLKQSLIWKKKKETRLELN, (SEQIDNO:437); XM_014118152.1, CASP8AP2, Ins, A_7, KEHFVFVSIC, (SEQIDNO:438); XM_014119762.1, LRRIQ1, Ins, A_7, KEHHEKRKRATAKQRNIKIKRRCKQTGNNK, (SEQIDNO:439); XM_014117920.1, C11H9orf84, Del, A_7, KEHMPLTF1, (SEQIDNO:440); XM_544889.6, BRWD1, Ins, A_7, KEHQSNQLC, (SEQIDNO:441); XM_014118968.1, ZNF800, Ins, A_7, KEHTGSTEK, (SEQIDNO:442); XM_534564.5, PBK, Ins, A_7, KEICIMFNSMYKYSCLSNAEAWLWYWGKCVPYEKISKRLVSFSLGCEKD, (SEQIDNO:443); XM_014122577.1, CEP295, Ins, A_7, KEICQNYKSATTTSKSF, (SEQIDNO:444); XM_003431866.2, ISPD, Del, A_7, KEIFYYVVFLYITHRRSRTYRQV, (SEQIDNO:445); XM_536312.4, CMYA5, Del, A_7, KEILLNLKMFQQTQKIIL, (SEQIDNO:446); XM_005638550.2, LRRC49, Ins, A_7, KEILQDVYGGPCEGSHGNQYEK, (SEQIDNO:447); XM_014110128.1, STX19, Del, A_7, KEILVRYCAVGVVHAVVQN, (SEQIDNO:448); XM 014110659.1, SYCP2L, Ins, A_7, KEIPKTVF, (SEQIDNO:449); XM_005634066.2, KDELC1, Ins, A_7, KEIQLTNPSNLFLVWLHRFQGYRDAYLRPD, (SEQIDNO:450); XM_532920.5, WDR43, Ins, A_7, KEIRSYRNE, (SEQIDNO:451); XM_014120231.1, ROCK2, Del, A_7, KEIRTLKYPPRK, (SEQIDNO:452); NM_001003222.1, CNGA1, Ins, A_7, KEKEKRKEEQIRR, (SEQIDNO:454); XM_005618268.2, TRPM1, Del, A_7, KEKGIKMSRIVV, (SEQIDNO:455); XM_014114536.1, TNRC6A, Ins, A_7, KEKGKGNHERWKQTRRSMDKSIR, (SEQIDNO:456); XM_536845.5, BAZ1B, Del, A_7, KEKGNGLHQNFCLTNMM, (SEQIDNO:457); XM_014110443.1, ZNF639, Del, A_7, KEKGRHYTLLVTQIPLE, (SEQIDNO:458); XM_005639570.2, PARP14, Del, A_7, KEKHLRLLPNSLWSLN, (SEQIDNO:459); XM_014120361.1, MYT1L, Del, A_7, KEKHRISSPKNLLPSGNRLP, (SEQIDNO:460); XM_005631271.2, LRP4, Ins, A_7, KEKKKKKG, (SEQIDNO:461); XM_005631005.2, ABCA13, Del, A_7, KEKQLTTLLTLRN, (SEQIDNO:462); XM_005633942.2, DIAPH3, Del, A_7, KEKQRKGKNVPK, (SEQIDNO:463); XM_014109202.1, CCNE2, Del, A_7, KEKRRPPGNSSMRLGIVGHLYYPGGSVHVLSLKHPTKKWEQVTSLDLQITDLKIFLLI LHLCLI, (SEQIDNO:464); XM_014115188.1, PRRC2C, Del, A_7, KEKTPNQALKNPKRK, (SEQIDNO: 466); XM_544645.5, UBR1, Ins, A_7, KEKTRKQR, (SEQIDNO:467); XM_003434948.2, DSC3, Del, A_7, KEKVFLKI, (SEQIDNO:468); XM_534311.5, DHX36, Del, A_7, KEKWSRFTQKLMD, (SEQIDNO:470); XM_005641516.2, ATRX, Del, A_7, KELENTVKKTQEMKEQKIKSIMNQIQILKNLRSQDTDIGF, (SEQIDNO:471); XM_859741.4, WAP1, Del, A_7, KELKQLHPPPCSLLLKALIIPRTVSLVLTMQKT, (SEQIDNO:472); XM_859725.4, WAP1, Del, A_7, KELKQLHPPPCSLLLKALIIPRTVSLVLTMQRTCLVCLKV, (SEQIDNO:473); XM_532130.5, DNAH8, Del, A_7, KELMISVSHVLC, (SEQIDNO:474); XM_005633366.2, CCDC67, Del, A_7, KELNPLIHLLLKN, (SEQIDNO:475); XM_005627496.2, COL21A1, Del, A_7, KELRGFLV, (SEQIDNO:476); XM_014116439.1, ABCA6, Del, A_7, KELSPSYGSQASILLPTGLGRHWWILASLFFFSFQCFYFCM, (SEQIDNO:478); XM_005627784.2, LOC102155928, Del, A_7, KELTGFPL, (SEQIDNO:479); XM_014118080.1, DST, Ins, A_7, KEMSFLLYHCVLCFQGHSWK, (SEQIDNO:482); XM_005633847.2, KPNA3, Del, A_7, KEMSPKKKV, (SEQIDNO:483); XM_014110232.1, GOLGB1, Del, A_7, KEMWKPSNKLSWRRISK, (SEQIDNO:484); XM_005626867.1, TEX10, Del, A_7, KENAKMIFKK, (SEQIDNO:485); XM_005636161.2, RSRC2, Ins, A_7, KENALARQKRRG, (SEQIDNO:486); XM_535027.5, FAM204A, Del, A_7, KENAPGKVN, (SEQIDNO:487); XM_014115747.1, LOC102156002, Ins, A_7, KENFNRNQPKMEFRSRKRR, (SEQIDNO:488); XM_003639068.2, ATMIN, Ins, A_7, KENGELPAQPKVVQ, (SEQIDNO:489); XM_005619382.2, NIPBL, Del, A_7, KENKILTHRRLGVLQEVIDQLLRRRVLREMGQGQH, (SEQIDNO:490); XM_549626.5, TMCO1, Ins, A_7, KENREARRETEK, (SEQIDNO:491); XM_536590.4, GUCY1A2, Ins, A_7, KENSGSSVFYFPW, (SEQIDNO:493); XM_014112357.1, LCOR1, Del, A_7, KENTLKMIISK, (SEQIDNO:494); XM_005641136.2, BMX, Ins, A_7, KENVAKQLREAFCFNQNKSLL1, (SEQIDNO:495); XM_536371.4, TET1, Del, A_7, KENVLLSPYLVLERRGQQ, (SEQIDNO:496); XM_005635695.2, DOCKS, Del, A_7, KEPHFMRTSLKQ, (SEQIDNO:497); XM_014111407.1, DOCK11, Del, A_7, KEPHPKSPGLPSSGGRKRPKLLSPWTMRMLSPKGKPRFTATPSETSLCFQWKNLSQ, (SEQIDNO:498); XM_014116869.1, CAMSAP1, Ins, A-7, KEQACVSASTLRPASCCQL, (SEQIDNO:499); XM_005630347.2, CEBPZ, Del, A_7, KEQLMTFNKVNWKHLFRILVWPSMQKLS, (SEQIDNO:500); XM_003638844.3, KIAA0355, Ins, A_7, KEQQWRQLIWHEPHT, (SEQIDNO:501); XM_014119939.1, ZNF786, Del, A_7, KEQRKANCPTSYL, (SEQIDNO:502); XM_850237.2, CLCA2, Del, A_7, KEQTRKRMEQN, (SEQIDNO:503); XM_014119186.1, FAM133B, Del, A_7, KERCILKINHYHLSPYQNQIILRRYEQKRRKAVKNEKK, (SEQIDNO:504); XM_005632477.1, LOC484748, Ins, A_7, KERERQRQKERKDRKKDKERERDEERRASTSNSTPSN, (SEQIDNO:505); XM_005624905.2, NSRP1, Del, A_7, KERKIILNCFWEKTESPSIFTTY, (SEQIDNO:506); XM_014111124.1, SGOL2, Ins, A-7, KERKIKETI, (SEQIDNO:507); XM_014112349.1, BOD1L1, Del, A_7, KERKIQGMLKRILKRNCNLKKIPKKLSRQVSIVKRKRYLLQRI, (SEQIDNO:508); XM_014114042.1, PMFBP1, Ins, A_7, KERKNDKRKFEDVGGGK, (SEQIDNO:509); XM_547771.4, CFL2, Del, A_7, KERKQFSSV, (SEQIDNO:510); XM_014120446.1, EML4, Ins, A_7, KERKITRTEGKKRGISF, (SEQIDNO:511); NM_001287118.1, CFDP1, Del, A_7, KERLRAFRPGRENKVASH, (SEQIDNO:512); XM_005617350.2, RBM27, Del, A_7, KERMASGETMTGTMSGMNCTVRNMTGEEAGVRVGVRAEA, (SEQIDNO:513); XM_014119702.1, CFAP54, Del, A_7, KERPTYHQMLKNFPHLLIPE, (SEQIDNO:514); XM_014117407.1, LOC102155766, Del, A_7, KERRDHFPNTCVQNTNGHL, (SEQIDNO:515); XM_014113223.1, DYNC2H1, Ins, A_7, KERRKEKKLS, (SEQIDNO:516); XM_014111364.1, FAM133A, Del, A_7, KERRLILKINLCLQNPHQNQIMKRKCKQKRREDMKSEKKQQKKQRRRRRGRRNSTRNIVRRRKRSRVQVTSQD, (SEQIDNO:517); XM_014118978.1, AKAP9, Ins, A_7, KERRLQNAN, (SEQIDNO:518); XM_535878.4, RIOK1, Del, A_7, KERRRQPG, (SEQIDNO:519); XM_014122593.1, MCM10, Ins, A_7, KERTTYLPGI, (SEQIDNO:521); XM_014117413.1, TLE1, Del, A_7, KERWMIRTPATMTAMVTKAMTT, (SEQIDNO:522); XM_014112204.1, CAST, Del, A-7, KERWRRTQ, (SEQIDNO:523); XM_014112203.1, CAST, Del, A_7, KERWRSRTQ, (SEQIDNO:524); XM_014115197.1, GORAB, Ins, A_7, KESGIARKISLGSPPTRATANGREK, (SEQIDNO:525); XM_849701.4, FGD6, Del, A_7, KESHSVLVGVLMRLTQKIKRKLVLLDQRLPSGSLIPEPQCV, (SEQIDNO:526); XM_014112483.1, ZFAND6, Ins, A_7, KESLFHVQEESGTYWV, (SEQIDNO:527); XM_014121706.1, CNTN6, Del, A_7, KESLILKGLEGRNLLGI, (SEQIDNO:528); XM_014115025.1, LUC100683727, Ins, A_7, KESMEEDGH, (SEQIDNO:529); XM_005618061.2, GIN1, Ins, A_7, KESPKRVP, (SEQIDNO:530); XM_849201.4, ATG5, Ins, A_7, KESSDDSWN, (SEQIDNO:531); XM_005624831.2, TEFM, Del, A_7, KESSRTTGS, (SEQIDNO:532); XM_536224.5, WHSC1, Del, A_7, KESTQRGHRSLLKTLTAKMHPGRDSGPTSTVFGRERRSMTRQPEQAPARPSRQPPHS RARQQRNICQMHANH, (SEQIDNO:533); XM_534539.6, IFT88, Del, A_7, KESTRMILLMKN, (SEQIDNO:534); XM_533861.5, KIAA1143, Del, A_7, KETCQLKKS, (SEQIDNO:536); XM_014106852.1, KIZ, Ins, A_7, KETGPGKETL, (SEQIDNO:537); XM_535949.5, KLHL41, Del, A_7, KETGRIWLQ, (SEQIDNO:538); XM_005629203.2, MGAT4C, Del, A_7, KETIYLRQSSQFLSNPATKS, (SEQIDNO:539); XM_544163.4, CPNE3, Ins, A_7, KETKEEKLQEFRCYQCETV, (SEQIDNO:540); XM_014116764.1, ATAD5, Ins, A_7, KETKEKDGNSR, (SEQIDNO:541); XM_014107297.1, PSMA7, Ins, A_7, KETKESIM, (SEQIDNO:542); XM_005626618.2, KDM4C, Ins, A_7, KETKNAELQV, (SEQIDNO:543); XM_014112822.1, ANK3, Ins, A_7, KETPQTVPGSEEKV, (SEQIDNO:545); XM_532056.6, ABCF1, Ins, A_7, KETRHPKRPKEEGCG, (SEQIDNO:546); XM_003639968.3, PDZRN4, Del, A_7, KETRKSWTTG, (SEQIDNO:547); XM_005636681.2, PTHLH, Ins, A_7, KETSNSVCLAKLWRG, (SEQIDNO:548); XM_005615345.2, VPS4B, Ins, A_7, KETTESTSRCHCYRATKCEMERCCWS, (SEQIDNO:549); XM_536846.5, NSUN5, Ins, A_7, KETTPDCGPSHTAPYRAGRKAV, (SEQIDNO:550); XM_014114292.1, KLK8, Ins, A_7, KEVHSTPGGSQPEE, (SEQIDNO:551); XM_014113160.1, CDH18, Ins, A_7, KEVIYSHHRRSKHTS, (SEQIDNO:552); XM_005640039.2, HIVEP1, Ins, A_7, KEVPSGARDHV, (SEQIDNO:553); XM_005622350.2, TMEM206, Del, A_7, KEVRQQTT, (SEQIDNO:554); XM_014110716.1, SCN1A, Ins, A_7, KEVWRSRHLHDRRTEEIL, (SEQIDNO:555); XM_005641516.2, ATRX, Del, A_7, KEWIIKGRKI, (SEQIDNO:556); XM_014119796.1, KDM7A, Del, A_7, KEWQPPNSVLGRFLS, (SEQIDNO:557); XM_005634410.2, COL6A5, Del, A_7, KEWSVKSARAVGKRIALWT, (SEQIDNO:558); XM_014120373.1, ALMS1, Ins, A_7, KEWVTIRSF, (SEQIDNO:559); XM_005616987.1, ENKUR, Ins, A_7, KFCKHKCSRCHYGSG, (SEQIDNO:560); XM_014115682.1, TTC6, Del, A_7, KFCKTTPLLPFMICVPLSQPRSCLLTCTWLLECTIQLTRKVTILCLRYWEPiS, (SEQIDNO:561); XM_538192.4, FMR1NB, Ins, A_7, KFCMGNSVEFFPSNNLHSKGE, (SEQIDNO:562); XM_005622295.2, ZBTB41, Del, A_7, KFCNVLNVIRHLTA, (SEQIDNO:563); XM_005623023.2, ROCK1, Del, A_7, KFCSIMMNKIRNNPIHPWYWT, (SEQIDNO:564); XM_014115665.1, ZBTB1, Ins, A_7, KFCVQIIYSKRTCVTALWTEFYL, (SEQIDNO:565); XM_005640330.2, GPR155, Ins, A_7, KFCWTNSGVCSIVQLPL, (SEQIDNO:566); XM_537272.5, HAUS1, Ins, A_7, KFDCNVSVRKMSTRGSKEGRAASLYRKGQS, (SEQIDNO:567); XM_005628611.2, DNAH11, Ins, A_7, KFDTEADYFESSAP, (SEQIDNO:568);

XM_005638799.2, USP16, Ins, A_7, KFEKDNGG, (SEQIDNO:569); XM_014109056.1, SMC3, Del, A_7, KFENLDHFPRKHLKSTRH, (SEQIDNO:570); XM_014118548.1, RGS22, Del, A_7, KFFETSNLEIPSMML, (SEQIDNO:571); XM_005628254.2, CENPC, Ins, A_7, KFFNNFRNCKTKK, (SEQIDNO:572); XM_543416.5, FBXO21, Del, A_7, KFFTTYANRKF, (SEQIDNO:573); XM_003433570.1, SLC15A5, Del, A_7, KFGLESACFWWRCVRGSLSLKLSAI, (SEQIDNO:574); XM_014116163.1, LOC100688895, Del, A_7, KFGLSRTARAQTGACRAAY, (SEQIDNO:575); XM_535238.5, DHX29, Ins, A_7, KFGSKYERMDLAVC, (SEQIDNO:576); XM_539002.5, COL12A1, Del, A_7, KFHTKVATQ, (SEQIDNO:577); XM_532397.5, CABS1, Ins, A_7, KFHYSRHNCLYRRENN, (SEQIDNO:578); XM_005618917.2, RTKN2, Del, A_7, KFIISLSSTLLPDSL, (SEQIDNO:579); XM_014112848.1, RUFY2, Del, A_7, KFMNRSKLFKNLATNLANQNLK, (SEQIDNO:580); XM_014116492.1, NF1, Ins, A_7, KFISLSVDYIGYTGKMSCWATKGHDEIR, (SEQIDNO:581); XM_846170.4, CAPN7, Del, A_7, KFITQVTRLHTLMAFELTALII, (SEQIDNO:583); XM_005641236.2, CFAP47, Del, A_7, KFITSKMK, (SEQIDNO:584); XM_005619358.2, ZNF131, Del, A_7, KFIYVNTVRNSLTTLDILKSIFGNIQVKNLLNVQIVMNDLLEIAPSNVT, (SEQIDNO:585); XM_014112357.1, LCOR1, Ins, A_7, KFKEVDTQ, (SEQIDNO:586); XM_014111598.1, MBTPS2, Ins, A_7, KFKFKFLYNTFFGNSHSLNKSETSTSN, (SEQIDNO:587); XM_014107055.1, LOC106557703, Del, A_7, KFKKQHLT, (SEQIDNO:588); XM_014115771.1, NGDN, Del, A_7, KFKLEPILQRRVSASWK, (SEQIDNO:589); XM_847666.4, PPM1D, Ins, A_7, KFKNVNSRSNESPRS, (SEQIDNO:590); XM_005637264.2, RAD51AP1, Del, A_7, KFLFQRSLGNHHKYAALQLKAENLSGSHQ, (SEQIDNO:591); XM_532881.5, RAD51AP2, Del, A_7, KFLFQWILMTGMKFL, (SEQIDNO:592); XM_843857.4, HNRNPD, Del, A_7, KFLLVAFLQIHLKKK, (SEQIDNO:593); XM_014117399.1, CCDC138, Del, A_7, KFLLYVSYTVS, (SEQIDNO:594); XM_849254.4, RPL26L1, Del, A_7, KFLNAKPNLDRSEKRKANIRKNLLRKCRS, (SEQIDNO:595); XM_005619238.2, ZBED8, Del, A_7, KFLVSQTSLNRSYSYSRSHC, (SEQIDNO:596); XM_014106493.1, TTC21A, Del, A-7, KFLWLAGCVGGTRRFYS, (SEQIDNO:597); XM_014115270.1, DNAH14, Del, A_7, KFMILQTSQKNQS, (SEQIDNO:598); XM_005622923.1, CCDC178, Del, A_7, KFMINLLGREKVMKRSIWMYLIIIMPQKHHGILSFLMLQKTFQISQLQMLS, (SEQIDNO:599); XM_014115932.1, KIAA0586, Del, A_7, KFMQMQFLLFLLKKTRTLWFHRKQPTIQRTWKTVQVSLVKDKGLG, (SEQIDNO:600); XM_848323.4, EYS, Del, A_7, KFMWIIADPRILLC1HCPLLLLLV, (SEQIDNO:601); XM_005618201.2, LOC479005, Ins, A_7, KFPAHRQRSGRTCKSWIPSSSLLCLCLLTQGLAVRGGCRSLQRAVAGVPGCLESSA, (SEQIDNO:602); XM_014111937.1, CFAP47, Del, A_7, KFPDRTTFQNIIRPFMM, (SEQIDNO:603); XM_005623657.2, CCDC176, Ins, A_7, KFPEVARDSDFPFTSKGDQ, (SEQIDNO:604); XM_014108601.1, SLC4A8, Del, A_7, KFPLGQRPQMSWLERWIVWTAPLLPL, (SEQIDNO:605); XM_536590.4, GUCY1A2, Del, A_7, KFPTTLAPCSSGRQAS, (SEQIDNO:607); XM_005633789.2, LOC100856360, Del, A_7, KFPVMSTS, (SEQIDNO:608); XM_005628995.2, ZCCHC11, Del, A_7, KFQALLLLWTK, (SEQIDNO:609); XM_535625.5, GK2, Del, A_7, KFQEIITLSSPRQAFHLALTSVQ, (SEQIDNO:610); XM_005636067.2, GOLGA3, Ins, A_7, KFQIKQNSVSG, (SEQIDNO:611); XM_003833885.2, SPESP1, Del, A_7, KFQILSHRYNRYLLLKASSQNTERIFEPLESI, (SEQIDNO:612); XM_532047.5, CNTR1, Del, A_7, KFQKRRKTFFSSS, (SEQIDNO:613); NM_001003294.1, DLD, Del, A_7, KFQKRWLSLVQE, (SEQIDNO:614); XM_014110462.1, ZBBX, Ins, A_7, KFQLPWLLPSSIKKCSCSIII, (SEQIDNO:615); XM_005625995.2, IL1RL1, Ins, A_7, KFQNILSYN, (SEQIDNO:616); XM_005640594.2, PIKFYVE, Del, A_7, KFQVERSLILWLSMDLFVPKILHIKR, (SEQIDNO:617); XM_014120087.1, LOC607729, Ins, A_7, KFRCAIEKSFENTSRYG, (SEQIDNO:618); XM_534816.5, CCDC65, Del, A_7, KFRDYRTP, (SEQIDNO:619); XM_005627018.2, TFAP2B, Del, A_7, KFRFLPN1, (SEQIDNO:620); XM_014113689.1, SGIP1, Del, A_7, KFRRKAMGHQMDFMRKLIGKDITPLSWMKKATASDLRNPALPKESTFILQANRKRK KNHTRNLTSRLSHCNLKTFLRMLQP, (SEQIDNO:622); XM_005640670.2, CCDC108, Ins, A_7, KFRSPHLLLPQPQREDPARHNCSGLVDLLTY, (SEQIDNO:623); XM_014112960.1, FAM35A, Del, A_7, KFSCHTINTLYI, (SEQIDNO:624); XM_539084.5, REV3L, Ins, A_7, KFSEETSGNSQTE, (SEQIDNO:625); XM_005627714.2, SLC16A10, Del, A_7, KFSILPSSR, (SEQIDNO:626); XM_846103.4, LMTK2, Del, A_7, KFSLCDGPLQN, (SEQIDNO:627); XM_014114597.1, LOC102156157, Del, A_7, KFSLERKGMNLRP, (SEQIDNO:628); XM_859534.4, WNK3, Del, A_7, KFSNKVTTSHLSAQLMKLMYLQ, (SEQIDNO:629); XM_005620779.2, PRMT7, Del, A_7, KFSRLTTWKIKLI, (SEQIDNO:630); XM_005638476.2, VPS13C, Ins, A_7, KFSSAESDCIL, (SEQIDNO:631); XM_005621931.2, GLMN, Ins, A_7, KFSYASAVY, (SEQIDNO:632); XM_014121650.1, MYO3A, Ins, A_7, KFSYFLLHLCWIS, (SEQIDNO:633); XM_843944.4, NSUN3, Ins, A_7, KFTFKGLSHPLSGVFALPP, (SEQIDNO:634); NM_001003144.2, CHRNA1, Del, A_7, KFTFPRKRSGAQTSFSITMQMVTLPLSSSPKCSWTTRATSHGHLRPSSKATVRSLSPT FPLMNRTA A, (SEQIDNO:635); XM_014108414.1, PLEKHA5, Del, A_7, KFTILERDLIQLKGILMHLWSDEVGFINRTVLA, (SEQIDNO:636); XM_535836.5, KNG1, Del, A_7, KFTLLSTVSHWERSY, (SEQIDNO:637); XM_014121550.1, ZNF660, Del, A_7, KFTNVRSVGKHVFLIQRL, (SEQIDNO:638); XM_005634030.1, IPOS, Del, A_7, KFVILLQSWPGI, (SEQIDNO:639); XM_005638131.2, FSBP, Ins, A_7, KFWIVCSGEEGWIEKKAAARGRAAKSKN, (SEQIDNO:640); XM_014119209.1, CFAP69, Del, A_7, KFWKLLQQHQKILARWLLLFKAR, (SEQIDNO:641); XM_014107673.1, TRAF3IP1, Del, A_7, KFWRPRKIMRSYSGHPDLERRAATGTNLV, (SEQIDNO:642); XM_014107674.1, TRAF3IP1, Del, A_7, KFWRPRKIMRSYSGHPDLERRRNCLSLSQHGRRRRT, (SEQIDNO:643); XM_005637236.2, CHD4, Ins, A_7, KGAGGQLWGGAGVCGGGGRGGSSLRQ, (SEQIDNO:644); XM_005622874.2, GALNT1, Ins, A_7, KGARTSCWGCSRASTKAS, (SEQIDNO:645); XM_542654.5, NALCN, Ins, A_7, KGASRNEKESAGRGAERESPILRQATVHSWTGAQVQKLLPGGGPGTLQCI, (SEQIDNO:647); XM_005637237.2, CHD4, Ins, A_7, KGAYALMPAAGGQLWGGAGVCGGGGRGGSSLRQ, (SEQIDNO:648); XM_536846.5, NSUN5, Del, A_7, KGDHAGLWPLAHCPLQSRKESG, (SEQIDNO:650); XM_538328.5, SMC1B, Del, A_7, KGDMTFSASVLSTFQSLLMKSTRS-

SAETSVPRHFLAQRTQKSLT, (SEQIDNO:651); XM_005632616.2, SETD2, Del, A_7, KGDRNWR-VILKVMVNFRTERKFEWRWSRGKRQCP, (SEQIDNO: 652); XM_014118575.1, OXR1, Del, A_7, KGEDINQLI-INIL, (SEQIDNO:653); XM_003639443.3, OXR1, Del, A_7, KGEDINQLIINILW, (SEQIDNO:654); XM_014117985.1, CNTLN, Ins, A_7, KGEDTNRRMFQQEGIN, (SEQIDNO:655); XM_014113564.1, CHD3, Ins, A_7, KGEEDKAAEKRG-GRWGTKAGRTEVVSHSASDLGPGGRGTCVL, (SEQIDNO:656); XM_014113549.1, CHD3, Ins, A_7, KGEEDKAAEKRGGRWGTKGRTEVVSHSASDLGP-GRGTCVL, (SEQIDNO:657); XM_537657.5, CWC25, Ins, A_7, KGEEEKEGKEKEAQET, (SEQIDNO:658); XM_014114536.1, TNRC6A, Del, A_7, KGEGKGEP, (SEQIDNO:659); XM_844090.4, INO80, Del, A_7, KGEGMKNSPLKNLLVAITTRPKSLPSSLMMHLLLAP-RRSTYPSSSLMLVAEKYG1A1, (SEQIDNO:660); XM_014106851.1, CTCFL, Ins, A_7, KGEGSKTNLPL, (SEQIDNO:661); XM_014120175.1, WDR17, Ins, A_7, KGENCIWSY, (SEQIDNO:662); XM_544645.5, UBR1, Del, A_7, KGENKKTKMKHYHHHHLLNSALL-SAKWLTFSIVIS, (SEQIDNO:663); XM_014122593.1, MCM10, Del, A_7, KGENNLPTWNLKNFRKF, (SEQIDNO:664); XM_014121595.1, LOC106560076, Ins, A_7, KGETWEKSVHDCS, (SEQIDNO:665); XM_014109094.1, KIF20B, Ins, A_7, KGFHTSII, (SEQIDNO:666); XM_850643.4, SH3RF1, Ins, A_7, KGFIEVAFWRLH, (SEQIDNO:667); XM_005616337.2, IZUMO1, Ins, A_7, KGFLSQQMWSDVADSDLVP, (SEQIDNO:668); XM_860876.4, SPAG9, Ins, A_7, KGFTDPSGIFRISNKTT, (SEQIDNO:669); XM_005635616.2, CLCN3, Ins, A_7, KGGAIS-CLSCRGFCSFWCTNWRSSF, (SEQIDNO:670); XM_014113675.1, PTPRK, Del, A_7, KGGATIL-TPTTSSLLKNAKMPWGTPGRR, (SEQIDNO:671); XM_014108010.1, MYO18B, Ins, A_7, KGGDSRDSS-WPPGQH, (SEQIDNO:672); XM_535304.5, CHD9, Del, A_7, KGGEGGRMSKVLTSSFLTEINHLIMLL, (SEQIDNO:673); XM_545270.2, LOC488146, Ins, A_7, KGGGGEGRRMF, (SEQIDNO:675); XM_005617790.2, SRRM1, Ins, A_7, KGGHEQSKFGGYKALDNKTSNG-NPWV, (SEQIDNO:676); NM_001003060.2, FMO3, Ins, A_7, KGGKAQMVWHQRDSTDGLY, (SEQIDNO:677); XM_005616571.2, LOC100684414, Del, A_7, KGGKTFHHGLRFAQQHSIPTG, (SEQIDNO:678); XM_014107827.1, CLIP1, Ins, A_7, KGGNEPQPVPGS-ESQV, (SEQIDNO:680); XM_005640523.2, NIF3L1, Ins, A_7, KGGPHSLLPSTYFSTLKTHNLENLE-GAPGDPGSGKQSWYLLSSHRL, (SEQIDNO:681); XM_014108788.1, MK167, Del, A_7, KGGSPLVVV, (SEQIDNO:682); XM_005620292.2, ACAD8, Ins, A_7, KGGVELTANPRGDL, (SEQIDNO:683); XM_014121542.1, LOC106560070, Ins, A_7, KGHCDHSLTHEFLCGHVLFGLHCLLFFKNVVEQ, (SEQIDNO:684); XM_545798.5, NIPA1, Ins, A_7, KGHRARQAARYLL-FNRHCVVGRHNCNGCWPDWKLPGLHSGPHSPGD-STGCPWSAI WVHFSFLSSEGKAQYLGQIGVSAKL-CRFCCADYPLPKI, (SEQIDNO:685); XM_005624373.2, NMT1, Ins, A_7, KGHSSSAPAPHQVPEAVPPHASHEP-GGGGALVLSPGEYH, (SEQIDNO:686); NM_001286231.1, TAF9, Ins, A_7, KGINFCGKNNSSTVKCWFCY, (SEQIDNO:687); XM_005617803.2, STPG1, Ins, A_7, KGIQQSSQEIL1, (SEQIDNO:689); XM_005620109.2, SPECC1, Del, A_7, KGISCWHLKQPKV, (SEQIDNO:690); XM_005642451.2, TDRD3, Del, A-7, KGITLCK-ADQAKVHPMQRQRKIHLLKNP-LIIITRNVGKEKTKQQILIIFMTGNHEQVT KLSVV, (SEQIDNO:691); XM_005635696.1, ADAM7, Del, A_7, KGITLIMFYYSVGSGSTHMHKELLFQRAY-VCPITPPVLLRIFCLT, (SEQIDNO:692); XM_847163.4, LOC491346, Del, A_7, KGITLRKADQAKVHPMQRQRKIHLLKNP-LIIITRNVGKEKTKQQILIIFMTGNHKQVT KLSVV, (SEQIDNO:693); XM_532236.6, UFL1, Ins, A_7, KGKADTVPASTSTG, (SEQIDNO:694); XM_005636161.2, RSRC2, Del, A_7, KGKCFGKAKKKGINPNLLKYGKN, (SEQIDNO:695); NM_001003057.1, TCOF1, Ins, A_7, KGKEEEGKKGLNQRP, (SEQIDNO:696); XM_535126.4, LOC477937, Del, A_7, KGKEMKKIKKFLQPNQQE, (SEQIDNO:697); XM_846752.4, ZNF318, Ins, A_7, KGKGHEGNKRG, (SEQIDNO:699); XM_532236.6, UFL1, Del, A_7, KGKGRYCSSIDKHWLSS, (SEQIDNO:700); XM_005641869.2, MAP7D3, Ins, A_7, KGKHQTDTL, (SEQIDNO:701); XM_014113223.1, DYNC2H1, Del, A_7, KGKKKRKKAQLISIF, (SEQIDNO:702); XM_537751.5, NUFIP2, Del, A_7, KGKL-GAIVPRVVKTL1, (SEQIDNO:703); XM_014116492.1, NF1, Ins, A_7, KGKQKISG, (SEQIDNO:704); XM_014113123.1, FYB, Del, A_7, KGKRRKRRD, (SEQIDNO:707); XM_538677.5, MLLT3, Del, A_7, KGKR-VAQRLYLKVFLAHHH, (SEQIDNO:708); XM_005626022.2, EIF5B, Del, A_7, KGKTLMKMIS, (SEQIDNO:709); XM_005641869.2, MAP7D3, Del, A-7, KGKTSDRHL, (SEQIDNO:710); XM_005625969.2, 43353, Ins, A_7, KGKYSFFNYVWPCWL, (SEQIDNO:712); XM_014115269.1, DNAH14, Del, A_7, KGLCHMIE, (SEQIDNO:713); XM_546502.5, MPZL2, Ins, A_7, KGLCLFRRHRL, (SEQIDNO:714); XM_005637210.2, C1S, Ins, A_7, KGLETSLPWRSNPLFQRSHCQFCLGA, (SEQIDNO:715); XM_014110401.1, PHC3, Del, A_7, KGLFWIIR, (SEQIDNO:716); XM_005628768.2, AASS, Ins, A-7, KGLGSWIWLCI, (SEQIDNO:717); XM_005625404.2, RBM18, Del, A_7, KGLLLILEQLGN-LED, (SEQIDNO:718); XM_536010.5, TMEFF2, Ins, A_7, KGLQCIVRCSRPRAISVCLNRSCDWNHSDCRHLCGG-PLHHQEMPQKQQNSQTEAKY RALQFRQHNKSI-HEVNL, (SEQIDNO:719); XM_005634010.2, SLITRK1, Ins, A_7, KGLYKSAAFHRPDFPVLPSISAW, (SEQIDNO:721); XM_005629212.2, C15H12orf50, Del, A_7, KGNGFMMNRRIFLAQECGEQYSPQIPKIK, (SEQIDNO:722); XM_005629213.1, C15H12orf50, Del, A_7, KGNGFMMNRRIFLAQECGEYSPQIPKIK, (SEQIDNO:723); XM_014112822.1, ANK3, Del, A_7, KGNTANGP-GIGRKSLMPMQVT, (SEQIDNO:725); XM_014117291.1, GOLM1, Ins, A_7, KGPKPAAPSPQ, (SEQIDNO:728); XM_014116352.1, EFCAB13, Ins, A_7, KGQEKEKFTSTIAY, (SEQIDNO:729); XM_005625106.2, SEC16A, Del, A_7, KGQKLICQT-TRTNRSSGMKRRTGGWM, (SEQIDNO:730); XM_003639492.3, TFEC, Ins, A-7, KGQPQPHRKKKKV, (SEQIDNO:732); NM_001204095.1, ANKHD1, Ins, A_7, KGQRGDNPQHQSEK, (SEQIDNO:733); XM_537467.4, PPM1A, Del, A_7, KGQRGLRKNRRKGEK, (SEQIDNO:734); XM_005621609.2, CORO7, Ins, A_7, KGRAAKCYGGKAGEPGGSAPPG11, (SEQIDNO:735); XM_005635616.2, CLCN3, Del, A_7, KGRCYQLPQLQGFL, (SEQIDNO:736); NM_001003060.2, FMO3, Del, A_7, KGRESSNGLAPAR-QYRRIIMWMNLPPSLGQSPIS-RGCSSQIPNWLWRFSLALAAHTN LG, (SEQIDNO:

737); XM_005618461.2, AFAP1, Ins, A_7, KGRFHSRCEANIFKC, (SEQIDNO:738); XM_005634496.2, CEP70, Ins, A_7, KGRGPRETR, (SEQIDNO:740); XM_005627752.1, LOC100856021, Ins, A_7, KGRKQSQRTA, (SEQIDNO:741); XM_014121376.1, TNIP3, Ins, A_7, KGRRAENETGRGRKIPRRAGEGEGTDSEGQRQAARPDPPAAAAPGEGKGEPK, (SEQIDNO:742); XM_005627838.2, UBR5, Ins, A_7, KGRRRTECGARRS, (SEQIDNO:743); NM_001038648.1, TMEM57, Del, A_7, KGRSWKKLLLPGPLHLLLHLGGSAPKPYGIGSEN, (SEQIDNO:744); XM_534762.5, MRPL40, Del, A_7, KGSDDWRKLARS, (SEQIDNO:745); XM_005636842.2, FAM186A, Ins, A_7, KGSLNATIVFSEAN, (SEQIDNO:747); XM_014118910.1, AVL9, Ins, A_7, KGSLLYFSSE, (SEQIDNO:748); XM_536459.3, GEMIN5, Del, A_7, KGSLNLSQSPKRRKSPPQELL, (SEQIDNO:749); XM_844507.4, AIDA, Del, A_7, KGSPAPSALLSWRWMKLKPGR1, (SEQIDNO:750); XM_005630829.2, FLG, Del, A_7, KGSPNPQNEIQYLPVQRDKVATIS-SHRTPPDTRKLDMDPVTANTGNPVSVRPATVKD NH, (SEQIDNO:751); XM_005632455.2, GNL3, Ins, A_7, KGSRAPSKIEEGGQKARSQKA, (SEQIDNO:752); XM_014107556.1, FDFTI, Ins, A_7, KGSTATQLSLLPL, (SEQIDNO:753); XM_014114292.1, KLK8, Del, A_7, KGSTQYAWGITA, (SEQIDNO:754); XM_014110067.1, STPG2, Ins, A_7, KGSTRAWKI, (SEQIDNO:755); XM_005628768.2, AASS, Del, A_7, KGSWFLDLVM-YLNPFWNTCQEITG, (SEQIDNO:756); XM_014111664.1, DACH2, Ins, A_7, KGTANGAL, (SEQIDNO:757); XM_014106867.1, MYBL2, Del, A_7, KGVLPCPLSQRTAPACPS, (SEQIDNO:758); XM_005629765.2, SH2D4A, Ins, A_7, KGVPASDIQAEEREWQICSLETGSR, (SEQIDNO:760); XM_014111832.1, PIGA, Del, A_7, KGVRIMRCLKPG, (SEQIDNO:761); XM_844509.3, NPM2, Del, A_7, KGWKKKRRQ, (SEQIDNO:762); XM_014115441.1, SLC14A1, Del, A_7, KGWLKALC, (SEQIDNO:763); XM_005636978.2, KIF21A, Del, A_7, KGYRNLRKAIEKKEV-WPVKRIIQTLTKRRKKKRVLQKEKTMN, (SEQIDNO:764); XM_014113043.1, TTC1, Ins, A_7, KHARRGETEKKRREH, (SEQIDNO:765); XM_005619751.1, NXPE4, Ins, A_7, KHCHCYFSGPAFQALPH, (SEQIDNO:766); XM_532378.4, PDCL2, Ins, A_7, KHCRCDGIFN, (SEQIDNO:767); XM_005620651.1, HSBPI, Ins, A_7, KHCRPHDPGWGGRAGGGEQDPCHTEEL, (SEQIDNO:768); XM_005620592.1, MTHFSD, Del, A_7, KHCWSQHHD, (SEQIDNO:769); NM_001313804.1, ALCAM, Ins, A_7, KHDCFNSYHSSLFGFVLKPKWRSDQADWRCLACVMHNIC, (SEQIDNO:770); XM_005628489.1, GTPBP10, Ins, A_7, KHDSKEDHGVPTYHPHLCNYRRRNR, (SEQIDNO:771); XM_844824.2, LOC607953, Ins, A_7, KHELWWMCGPALCGYGVGIL, (SEQIDNO:772); XM_005629406.2, SFPQ, Ins, A_7, KHERCERQIGK, (SEQIDNO:773); XM_014121388.1, IWS1, Ins, A_7, KHEWQAQA, (SEQIDNO:774); XM_014110870.1, FSIP2, Ins, A_7, KHGNNETNFHIKSKPFVCNI, (SEQIDNO:775); XM_014114190.1, ZAN, Ins, A_7, KHGPHRKTHLPK, (SEQIDNO:776); XM_005633672.2, USP47, Del, A_7, KHGRILALSFWIIIFMKKILIFPATGRFSLKFLMG, (SEQIDNO:777); XM_014115878.1, FAM179B, Ins, A_7, KHGSRIRYYSKSSVAQG-WRIKYNKRRC, (SEQIDNO:778); XM_005618160.2, SSBP2, Ins, A_7, KHHIGGTTRILT-FLVVCILGSLLCSSRKTGNM, (SEQIDNO:779); XM_014113244.1, SSBP3, Ins, A_7, KHHIGRTAWV-FALVVVCILGPLLCSS, (SEQIDNO:780); XM_014106743.1, XRN1, Del, A_7, KHKG-YAHQKKPHFTSYTCL, (SEQIDNO:781); XM_005624533.2, TOP2A, Del, A_7, KHKWLKFCLL-LAEKESSPE, (SEQIDNO:782); XM_005615469.2, PHACTR2, Del, A_7, KHLCLQKGLLLGQAPRLTKCLLLKKLPRLL-VSRPPSLHPSQQAETRPERLLVPLIQKK QLGPNHQL HHLLPPPHLVPELRRRHSLAKQGQ, (SEQIDNO:783); XM_014113470.1, CEP126, Del, A_7, KHLKRNEKNKK-NENNKSESKSFSKGKRSLKKSRKSSSVPIFPFHSGG-GQFFKNQFLP WKKPSSKFRNPTYNQK, (SEQIDNO:784); XM_014112460.1, AP3B2, Del, A_7, KHL-PAAKVPPWPRRSPCLT, (SEQIDNO:785); XM_005635475.2, PDS5B, Del, A_7, KHLSQIQKRN, (SEQIDNO:787); XM_005634064.2, CCDC168, Del, A_7, KHLTCIFQSRRHL, (SEQIDNO:789); XM_005638404.2, TRPM7, Del, A_7, KHLTLARVKQFNFKH, (SEQIDNO:790); XM_014114271.1, ZNF789, Del, A_7, KHLVRIQPLFDIS, (SEQIDNO:791); XM_014106295.1, MYCBP2, Del, A_7, KHLYNKSK, (SEQIDNO:792); XM_538101.4, TNMD, Del, A_7, KHMTWSTL-STAMERRRRFTWKLIL, (SEQIDNO:793); XM_014114838.1, RPAP2, Ins, A_7, KHNEKESWSES, (SEQIDNO:794); XM_014112334.1, PRC1, Del, A_7, KHPRLAGTEPTRRTWSSMAAS, (SEQIDNO:795); XM_531753.4, BPIFC, Ins, A_7, KHPRPKRF, (SEQIDNO:796); XM_531770.5, GCC2, Ins, A_7, KHQNQAAACENQKRTGRFKASRN, (SEQIDNO:797); XM_537623.5, LSM12, Ins, A_7, KHRSHGRSCYYTPIS-SGK1, (SEQIDNO:799); XM_005620768.2, NFAT5, Ins, A_7, KHSCQIGF, (SEQIDNO:800); XM_844295.4, TNKS, Del, A_7, KHSLWKSLIS-NNHSLMKLRCTVLWPPCIPNESK, (SEQIDNO:801); XM_014116355.1, BPTF, Del, A_7, KHSYRRIMTPLFLL-PRALHFHQYLKVLMIEIPHLCQKQ, (SEQIDNO:802); XM_005630591.1, DCDC2C, Ins, A_7, KHTCTTRTR-SKNRRPKRTTHGTRTTRIIIKTIRRRI, (SEQIDNO:803); XM_014112960.1, FAM35A, Ins, A_7, KHTLL-CEDLRFGNTPGR, (SEQIDNO:804); XM_535482.5, SCG3, Del, A_7, KHTLQKISQVKAIIPLLIT, (SEQIDNO:805); XM_005640714.2, EPHA4, Ins, A_7, KHTNPNLPSVQRDGTQPE, (SEQIDNO:806); XM_014117987.1, SECISBP2, Del, A_7, KHTSKSL-TARRRPTDLCHRI, (SEQIDNO:807); XM_014107377.1, NBEA, Ins, A_7, KHVFWRFNETVPKASLLCCCEKL-FRMSAEAERQGEQIFPWQQ, (SEQIDNO:808); XM_014109413.1, SLTM, Del, A_7, KHVLLQEEKIQVLKGIPKISVTPEEMSLHHQEMN-LEKRTGEKSEENETRGEL, (SEQIDNO:809); XM_534172.5, TM9SF2, Ins, A_7, KHVTELSTSLDC, (SEQIDNO:810); XM_005641783.2, LOC102151581, Del, A_7, KHWISSTRSLPQDAVQ, (SEQIDNO:811); XM_532397.5, CABS1, Ins, A_7, KHYFGRRPHYSSK, (SEQIDNO:812); XM_539259.4, TEC, Del, A_7, KHYLQHQKQRSEGLPHQFHLKKRIIVKKSL, (SEQIDNO:813); XM_014108547.1, LRRK2, Ins, A_7, KHYVGRMWYKTFLIF, (SEQIDNO:814); XM_535026.4, RAB11FIP2, Del, A_7, KIAEDLINLTMGDLIALVT, (SEQIDNO:815); XM_857278.5, HELZ, Del, A_7, KIAQLFITMQRYSKWWNE, (SEQIDNO:816); XM_005636026.2, OAS2, Del, A_7, KIASNIQLQR-FRRPSREGRPAKAQL, (SEQIDNO:817);

XM_014120087.1, LOC607729, Del, A_7, KIAVDMGFAMIGLIVTVMLDILLQFVSHHHHHQEEVIMMDFGIHKRKATPYSESDML LLKKMAS, (SEQIDNO:818); XM_532457.5, CYP51A1, Del, A_7, KICLKLFRSS, (SEQIDNO:819); XM_014119368.1, LRBA, Del, A_7, KICLLVEFCDSVSD, (SEQIDNO:820); XM_005641161.2, CDKL5, Del, A_7, KICLNCWKKCQMGFHLKRLKVISIS, (SEQIDNO:821); XM_532881.5, RAD51AP2, Del, A_7, KICQRLQSTKYVSLLCSVILLRDTKVHLNGKEHRITENRKFQMNIAVQEHWTKNCFIP FPRKTARNLHLKGLLFSPMNLRKNLIIC, (SEQIDNO:822); XM_545603.5, NBEAL1, Del, A_7, KICSFCSKCISNFLTSVFGTVEIFPFELVNSIFPPSSKTAGEFSERSMVCNFS, (SEQIDNO:823); XM_014108317.1, LOC106557878, Del, A_7, KICSILKKLMELRTQKVEIQKLCHASILPFTI, (SEQIDNO:824); XM_014108877.1, HELLS, Del, A_7, KICTASTQIQMYLSS, (SEQIDNO:825); XM_005639041.1, PPP3CA, Del, A_7, KICWILMHRSQFVGTSMDNSLI, (SEQIDNO:826); XM_855010.4, WDR48, Del, A_7, KIDSLLVTCSKSGK, (SEQIDNO:828); XM_014115152.1, AXDND1, Del, A_7, KIESYWLKDFTSMKKLGINLLSISSYCCQPRTLQTLHYCTS, (SEQIDNO:829); XM_014112063.1, TMEM232, Del, A_7, KIFCSLINQKNHQN, (SEQIDNO:830); XM_005634466.2, SLC35G2, Del, A_7, KIFFNPEKCG, (SEQIDNO:831); XM_014109293.1, LRRCC1, Del, A_7, KIFIAWLYLPQIG, (SEQIDNO:832); XM_014121650.1, MYO3A, Del, A_7, KIFIFFTTSMLD, (SEQIDNO:833); XM_845734.4, NAPG, Del, A_7, KIFIRRLKITQMRKQLLKS, (SEQIDNO:834); XM_014110169.1, ACAP2, Del, A_7, KIFLKWLRLWLMARM, (SEQIDNO:835); XM_539103.4, FBXO43, Del, A_7, KIFQVVLQVFQGKRVLVL, (SEQIDNO:836); XM_005633957.2, LOC485485, Del, A_7, KIFRETIRCPGMRTRLLEKKTNPSGEKIKLFDEKTKPSEWTS, (SEQIDNO:837); XM_539084.5, REV3L, Del, A_7, KIFRRDFRKFSNRMISL, (SEQIDNO:839); XM_014118218.1, REV3L, Del, A_7, KIFRRDFRKFSNRMISLSEHYQDWTTAMDLRSSLLS, (SEQIDNO:840); XM_014116402.1, DDX42, Del, A_7, KIFTMSMKR, (SEQIDNO:841); XM_014118865.1, UTRN, Del, A_7, KIGCLKVRKKQ, (SEQIDNO:842); XM_844759.4, ADAM23, Del, A_7, KIGEPWQMKTTHHNRIAVISVTAMHCRKKSHCLQDSYTTSTKTRKALTMFLTQRQD TSKNTTRLSIWPRQASRLKPLAPNSFLTSH, (SEQIDNO:843); XM_014109172.1, PRKDC, Del, A_7, KIGIPGKKYITLRES, (SEQIDNO:844); XM_014115688.1, FERMT2, Del, A_7, KIGLIMLSGGKRRELGFLKHIGPWISMAFRQMLSFSSPPSTNCFAYSFPT, (SEQIDNO:845); XM_542243.5, ANKRD49, Del, A_7, KIGLLQCGGYCLKRLLM, (SEQIDNO:846); XM_014108105.1, FGF1, Del, A_7, KIGLLVSRRMEAANAVLGLTMVKKQFCFSPCQCPLI, (SEQIDNO:847); XM_005641603.2, BHLHB9, Del, A_7, KIGLRTGLR, (SEQIDNO:848); XM_532888.5, ATAD2B, Del, A_7, KIGWRTRRKIL, (SEQIDNO:849); XM_005630596.1, APOB, Del, A_7, KIHWSLVMVCSSR, (SEQIDNO:850); XM_005638363.2, SPG11, Del, A_7, KIIFLKMKKEL, (SEQIDNO:851); XM_014110829.1, METTL8, Del, A_7, KIIIRKGVVHQMVKGKRDHIFPT, (SEQIDNO:852); XM_014110062.1, ZGRF1, Del, A_7, KIIKYLLVRMTRCV, (SEQIDNO:853); XM_855243.4, BCLAF1, Del, A_7, KIINLKRLAT, (SEQIDNO:854); XM_539571.5, LOC482454, Del, A_7, KIIQEKNPLNA VTVGKPIAGRLTLQLIRKSIMERDPLCATIVGKRLRIKHNW, (SEQIDNO:855); XM_845588.3, BRE, Del, A_7, KIIRTAPDGMEMKWPKEQRLISKPLSLSSRRQRLPMESS, (SEQIDNO:856); XM_014107422.1, LOC606856, Del, A_7, KIITELWIP1, (SEQIDNO:857); XM_532793.5, IDO1, Del, A_7, KIKELEALMPWIS, (SEQIDNO:858); XM_014106387.1, NAA16, Del, A_7, KIKRKKEMKKKKKPVVSKKNLYLKN, (SEQIDNO:859); XM_539006.5, IMPG1, Del, A_7, KIKRKKYSNMFHLQNFGGYYQALILTSTQCC1HFLLITQRM11, (SEQIDNO:860); XM_014118898.1, LOC102152714, Del, A_7, KIKRRVRDEHLLNC, (SEQIDNO:861); XM_005623486.2, SYNE2, Del, A_7, KIKSCAHGWCRWKTKFCRRQILVLKK, (SEQIDNO:862); XM_005642331.2, LOC102153385, Del, A_7, KIKTEFSVIT1, (SEQIDNO:863); XM_005638131.2, FSBP, Del, A_7, KILDCMFRRRGMD, (SEQIDNO:865); XM_005618153.2, XRCC4, Del, A_7, KILEQNRKWFLRYTSLKKRKT, (SEQIDNO:866); XM_014112240.1, XRCC4, Del, A_7, KILEQNRKWFLRYTSLKKRSLILHYLRRQKRSTAQLKTCL, (SEQIDNO:867); XM_014122800.1, BBOX1, Del, A_7, KILERSRFCPPLLWTLQTLEWITVISPYSPNTR, (SEQIDNO:868); XM_538192.4, FMR1NB, Del, A_7, KILHGKLC, (SEQIDNO:870); XM_014118978.1, AKAP9, Del, A_7, KILKLTIRSYRRTMLAFSR, (SEQIDNO:873); XM_014120092.1, TEX15, Del, A_7, KILLLRGQRCVRVEDMAENLKNISAF, (SEQIDNO:876); XM_014115152.1, AXDND1, Del, A_7, KILLRNFMSWMR, (SEQIDNO:877); XM_014120154.1, FAT1, Del, A_7, KILMLKHERRSGCKCWIQMT, (SEQIDNO:878); XM_858916.4, MED1, Del, A_7, KILMNFLSTLRVLLIFITFQGTTN, (SEQIDNO:879); XM_014107325.1, BRCA2, Del, A_7, KILMTVESISLRKITPIKQQL, (SEQIDNO:880); XM_005641566.1, BTK, Del, A_7, KILPLKDRFQEGVKSPVKWSRFQSLKGSLTPSRLYMMKGLFMSSPQLKN, (SEQIDNO:881); XM_005641567.1, BTK, Del, A_7, KILPLKDRFQLYMMKGLFMSSPQLKN, (SEQIDNO:882); XM 534297.5, U2SURP, Del, A_7, KILQISHPMKDHRLF1, (SEQIDNO:883); XM_531679.5, ZFC3H1, Del, A_7, KILRTQRFFIICANSSSYKIKEIIFFHFWGNLSHPSLNLGLRSIITWICFGIF, (SEQIDNO:884); XM_005638791.2, LTNI, Del, A_7, KILRYSFYIRN, (SEQIDNO:885); XM_014119437.1, CEP290, Del, A_7, KILSLSKI, (SEQIDNO:886); XM_534301.5, CP, Del, A_7, KILTKSLW, (SEQIDNO:887); XM_005622462.2, TDRD5, Del, A_7, KILVQQGVKSSQT, (SEQIDNO:888); XM_014119665.1, ZMYM1, Del, A_7, KILVVEENHLQAKEFLIGKRL, (SEQIDNO:889); XM_005627548.1, MYO6, Del, A_7, KIMMLYICLLNP, (SEQIDNO:890); XM_014120276.1, TDRD15, Del, A_7, KIMWTLMNFAW, (SEQIDNO:891); XM_014106380.1, AKAP11, Del, A_7, KINLKIHP, (SEQIDNO:892); XM_014109907.1, ANK2, Del, A_7, KINRMSRNGSRRGWHILLITLASAGQN, (SEQIDNO:893); XM_005623470.2, C8H14orf39, Del, A_7, KINTWKRERN, (SEQIDNO:894); XM_005619203.2, CREBRF, Del, A_7, KINWLPGLVD, (SEQIDNO:895); XM_014108622.1, DYRK4, Ins, A_7, KIPGFQGSHDGAENL, (SEQIDNO:896); XM_005623657.2, CCDC176, Del, A_7, KIPRSCKRLRLSFYIKRRSMIF, (SEQIDNO:898); XM_014111704.1, REPS2, Del, A_7, KIPSKEWTMRINRKHSLPRCHPSPPLLLPRLITRGCP, (SEQIDNO:899); XM_014111703.1, REPS2, Del, A_7, KIPSKEWTMRINSRKHSLPRCHPSPPLLLPRLITRGCP, (SEQIDNO:900); NM_001194952.1, PLAU, Del, A_7, KIPTLLQKKQSFNVARRL, (SEQIDNO:901);

XM_014114463.1, LOC106558915, Del, A_7, KIQAST-TAGFLAVVPACPWERLRVFLLQQRWGFAGIRYLVR-GLTGLL, (SEQIDNO:902); XM_536310.6, ZFYVE16, Del, A_7, KIQFWLNKGYLTVNLRLQMNYQSLILTI-SLFMLEGPDQSNCLTFHQDQEVQRNQINQ MFQI-CLKVSPA, (SEQIDNO:904); XM_014117552.1, KIAA1841, Del, A_7, KIQGLKAVLVQGVLH, (SEQIDNO:905); XM_544755.5, MYO9A, Del, A_7, KIQII-CALTL, (SEQIDNO:906); XM_014111106.1, ALS2CR11, Del, A_7, KIQIKKENQ, (SEQIDNO:907); XM_005629294.2, CCDC53, Del, A_7, KIQKKVQTVNLLLVT, (SEQIDNO:908); XM_014110816.1, USP48, Del, A_7, KIQMCGTLSNSSS-VENMLT, (SEQIDNO:909); XM_532552.5, UTP11L, Del, A_7, KIQMNSTIK, (SEQIDNO:910); XM_014116115.1, SPATA7, Del, A_7, KIQVSQTA, (SEQIDNO:912); XM_014108625.1, RECQL, Del, A_7, KIQVTSGSLQIRFSNLRIQGLRKEKLMMH, (SEQIDNO:913); XM_005640342.2, KIAA1715, Del, A_7, KIRDYKNYGLED, (SEQIDNO:914); XM_014111472.1, CYLCI, Del, A_7, KIRESQRIPRRQIMISYVQRRIL-RIHRTILMPNLRLVQKIVQIWI, (SEQIDNO:915); XM_014116428.1, NOL11, Del, A_7, KIREWLDHCC, (SEQIDNO:916); XM_544672.5, SECISBP2L, Del, A_7, KIRHFLEVEGRLNKEIIHRLDSDAEDIVLPQKEDRIC-RRDKIIISS, (SEQIDNO:917); XM_014113360.1, CEP85L, Del, A_7, KIRICKRLS, (SEQIDNO:918); XM_014118151.1, ANKRD6, Del, A_7, KIRKPREERL-GRTLEDQREKKRLETQHFMLLLP, (SEQIDNO:919); XM_005631802.2, SCLT1, Del, A_7, KIRLFFRR-SKKKKM, (SEQIDNO:920); XM_005638404.2, TRPM7, Del, A_7, KIRLQMDQNFF, (SEQIDNO:921); XM_003638878.3, KIF5B, Del, A_7, KIRPCGTPFSGLKMNSTGGVMERQCLL-MNSLTKRKPTWKLLQ, (SEQIDNO:922); XM_005638009.2, CHD7, Del, A_7, KIRRNRKNPRRKK-SPRNPRPRKPLRFPKSQRKRKQKLPRQNPNPAKSQ-VIRNLIQKQ VL, (SEQIDNO:924); XM_014115916.1, ATG14, Del, A_7, KIRSFILEHSGIKRKRRRFRG-TIANLVTW, (SEQIDNO:925); XM_014113440.1, EXPH5, Del, A_7, KIRVILGVEELAQQLPFLSFR-KAEQHLFPAQSKVVTRK, (SEQIDNO:926); XM_005616994.2. ARHGAP21, Del, A_7, KIRWNQET, (SEQIDNO:927); XM_536459.3, GEMIN5, Del, A_7, KISHFLCLN, (SEQIDNO:928); XM_005623084.2, TXNDC2, Del, A_7, KISHSSRLTSLISQQNP-SHPKRVTPPVF, (SEQIDNO:929); NM_001025397.1, SPINK5, Del, A_7, KISILATDQMRLNQHQKR-TRVMSLEAK, (SEQIDNO:930); XM_005640670.2, CCDC108, Del, A_7, KISITPSSAASTPT-GRSSQAQLLRSCGSSHLLRPRPTRWMCPY-TSWDGTQPSSASREW AMTPMSWGTQPHSTT-SPLGMTTPYILG, (SEQIDNO:931); XM_005639099.2, MRPL1, Ins, A_7, KISKTNSKFYWP, (SEQIDNO:932); XM_005639497.2, KIAA2018, Del, A_7, KIS-LFIPMGVSLVETAREQLFRG, (SEQIDNO:933); XM_014112381.1, LINS1, Del, A_7, KIS-LNTLKMRRWYIASGPLL1, (SEQIDNO:934); XM_005635238.2, NELFCD, Del, A_7, KISLSLLRW-CATGSTRTCLPRP, (SEQIDNO:935); XM_014111626.1, THOC2, Del, A_7, KISQNLQAKKKVVIRLNLKRWIK-SPPVAKRSPGMIKKR, (SEQIDNO:936); XM_005626023.2, EIF5B, Del, A_7, KISQVLMWRVGMKMMIPPSK-LRRWPKRRQKRKSVKEKREMKKKQNYGS, (SEQIDNO:937); XM_014106427.1, EPSTI1, Ins, A_7, KIS-RKPQKRSI, (SEQIDNO:938); XM_003639986.2, CEP55, Del, A_7, KISRLNDRP, (SEQIDNO:939); XM_014117962.1, LOC102153482, Del, A_7, KISSSGCC, (SEQIDNO:940); XM_534518.5, POMP, Del, A_7, KISSSTKIK, (SEQIDNO:941); XM_005635615.2, CLCN3, Del, A_7, KISSVIWPRRQTKTPLQ, (SEQIDNO:942); XM_849319.3, LOC611632, Del, A_7, KISTDLMLCCFL, (SEQIDNO:943); XM_014106605.1, GOLGA4, Del, A_7, KISTIKKLQSWLKNTKQN, (SEQIDNO:944); XM_014108806.1, SORBS1, Del, A_7, KISTSAQQS, (SEQIDNO:945); XM_534306.5, EIF2A, Del, A_7, KISWRKFKKRKPFSRSWKIWNWVF, (SEQIDNO:946); XM_014108253.1, MRPS35, Del, A_7, KISYKHFSK, (SEQIDNO:947); XM_014119765.1, ZNF112, Del, A_7, KITAAMTVERTS, (SEQIDNO:948); XM_014115454.1, TPGS2, Del, A_7, KITACYLRM, (SEQIDNO:949); XM_005624764.2, PIGW, Ins, A_7, KITCQRLDKSNILYSADSN, (SEQIDNO:950); XM_014116357.1, LOC102152996, Del, A_7, KITCVSRLIMVVGVEKEWLDY, (SEQIDNO:951); XM_547258.5, OLFM3, Del, A_7, KITESGTWT-VILTTKLFVSTNQLQTLSVGLNQGHTTSL-SNGQELTMLSTMAHSILTSIR VTSSSNTALIWGECSP-NEASSMLVFTTCTPIHGVDSLTST, (SEQIDNO:952); XM_014107338.1, NEK3, Del, A_7, KITPAESR, (SEQIDNO:953); XM_005630978.2, NAPEPLD, Del, A_7, KITVVFQAPKRNWTRSSRCCGPTSSTAPRPRG, (SEQIDNO:954); XM_014118218.1, REV3L, Del, A_7, KIVEQERRLRNRKLNLLIP1, (SEQIDNO:955); XM_014115234.1, PLD5, Del, A_7, KIVKINVELPWWKI-FLKALTIQKMHHFTYHFSKAG, (SEQIDNO:956); XM_538969.5, TINAG, Del, A_7, KIVLHHGHFLLQVWQLTE, (SEQIDNO:957); XM_846233.4, PPFIA1, Del, A_7, KIVNFKKSMNCSRKPGDKVC1IHSGMGRPLLFG, (SEQIDNO:958); XM_014122184.1, SMARCC1, Del, A_7, KIVRRSRTVKLVRILNQKKRKLRRTRNSLIL-VKKEKAISGRRK, (SEQIDNO:959); XM_014122183.1, SMARCC1, Del, A_7, KIVRRSRTVKLVRILNQKRKLRRTRNSLILVKKEKAI-SGRRK, (SEQIDNO:960); XM_014116359.1, LOC611199, Del, A_7, KIVSGAGGMKNWVAWRLH-CAGRPLSYWMTGCFSG, (SEQIDNO:961); XM_855384.3, USP15, Ins, A_7, KIVYIPVQQFRQY, (SEQIDNO:962); XM_014107158.1, BCAS1, Del, A_7, KIWKTRHPKQKVSVMAKRDRRPVRTKLKAPRK-STCTAPG, (SEQIDNO:963); XM_014117553.1, USP34, Del, A_7, KIWLILMVKNLGVKRN, (SEQIDNO:964); XM_846064.4, LOC608913, Del, A_7, KIWNVISMRR-PLVMVYTTLNIRKLILERNLMKIGKGISGTH-NLPPNIIRVFMVGRNIM CMKEP, (SEQIDNO:965); XM_014112852.1, CCAR1, Del, A_7, KIWPF-LIHQMLTNTVQR, (SEQIDNO:966); XM_005628224.2, PAICS, Del, A_7, KNENNFMEH, (SEQIDNO:967); XM_005625993.2, IL18R1, Del, A_7, KIYFFHIIALW-PAREAQTPSTLSC, (SEQIDNO:968); XM_014115915.1, DLGAP5, Del, A_7, KNHHKITSYRKRKPKFLSQYLILE-ASRLNAIFLIRRT, (SEQIDNO:969); XM_005626930.2, ZFP37, Del, A_7, KNLGLLKSNRK, (SEQIDNO:970); XM_014118218.1, REV3L, Del, A_7, KNLIFPTTCLR, (SEQIDNO:971); XM_544601.6, ARHGAP11A, Del, A_7, KNLKLMI, (SEQIDNO:972); XM_014113670.1, PTPRK, Ins, A_7, KNMLEKTHLH, (SEQIDNO:973); XM_005622326.2, LOC609365, Del, A_7, KIYTVKFLVLTVIEWFGVMIPHCVQRYCVSHLEK, (SEQIDNO:974); XM_531794.5, TMEM131, Del, A_7, KIYYPKSLLSSPG11, (SEQIDNO:975); XM_005622023.2, TTLL7, Ins, A_7, KKAENFYSKTS, (SEQIDNO:976); XM_005633847.2, KPNA3, Ins, A_7, KKCPPRRKFRRFRC, (SEQIDNO:977); XM_014121409.1, INPP4B, Ins, A_7, KKECRNHVAGCNDLSQTKRYSFHLLQKCQRQDVDVSDS, (SEQIDNO:978); XM_014112349.1, BOD1L1, Ins, A_7, KKERFKEC, (SEQIDNO:979); XM_547771.4, CFL2, Ins, A_7, KKESSSLLFKR, (SEQIDNO:980); XM_536762.5, ATP2C2, Del, A_7, KKFHSVQSRSGWQ, (SEQIDNO:981); XM_005624835.2, SUZ12, Ins, A_7, KKGCKLSNKASSYR, (SEQIDNO:982); XM_535878.4, RIOK1, Ins, A_7, KKGEDSQDEKGQI, (SEQIDNO:983); XM_014112203.1, CAST, Ins, A_7, KKGGGAGRNE, (SEQIDNO:984); XM_014112204.1, CAST, Ins, A_7, KKGGGGRNE, (SEQIDNO:985); XM_844383.3, ERMN, Del, A_7, KKGLPNNL, (SEQIDNO:986); XM_014119702.1, CFAP54, Ins, A_7, KKGQLTIRC, (SEQIDNO:987); NM_001287118.1, CFDP1, Ins, A_7, KKGSEHSGQEEKTRWLLIRRRGRGGCQ, (SEQIDNO:989); XM_014119150.1, DNAH11, Ins, A_7, KKHYFKVHWKS, (SEQIDNO:990); XM_544889.6, BRWD1, Del, A_7, KKISLKKRTCGG, (SEQIDNO:991); XM_005631143.2, QSER1, Del, A_7, KKKAWLVQ, (SEQIDNO:992); XM_535898.5, NUP153, Del, A_7, KKKCLPPKEGSLSVV, (SEQIDNO:993); XM_014110443.1, ZNF639, Ins, A_7, KKKEDITPFSLLRFLWNKQDCRWIQWNFF, (SEQIDNO:994); XM_014110273.1, KIAA1407, Del, A_7, KKKGERNSAGR, (SEQIDNO:995); XM_844375.4, EPRS, Del, A_7, KKKILQIGILRSSQSQK, (SEQIDNO:996); XM_014117069.1, GOLGA1, Del, A_7, KKKLWGKRSKSWRHEPEN, (SEQIDNO:999); XM_846664.4, SEC62, Del, A_7, KKKRKERPKVEKKKIKRAGKKI, (SEQIDNO:1000); XM_532159.4, TDRD6, Del, A_7, KKLKHSSLSLKPLR, (SEQIDNO:1002); XM_843366.4, CHD1, Del, A_7, KKLRDFLVQEGQRGEKQELRRIKQ, (SEQIDNO:1003); XM_005639750.2, FXR1, Del, A_7, KKLVKEMK, (SEQIDNO:1004); XM_014119437.1, CEP290, Del, A_7, KKMIITGSKCRSLQIF, (SEQIDNO:1005); XM_005630347.2, CEBPZ, Del, A_7, KKMPAKKKQYLK, (SEQIDNO:1006); XM_014109541.1, NUSAP1, Del, A_7, KKMRVRMELKLLHPPGMRLRCR, (SEQIDNO:1007); XM_005627829.2, RNF19A, Ins, A_7, KKNFNRLSVSEEKG, (SEQIDNO:1008); XM_534311.5, DHX36, Ins, A_7, KKNGQGLHKN, (SEQIDNO:1009); XM_014110756.1, BAZ2B, Ins, A_7, KKNGRKHFC, (SEQIDNO:1010); XM_863229.4, TAOK1, Del, A_7, KKNKSGFQSRRRIYSISKQRKRLIFFDDKGNT, (SEQIDNO:1011); XM_014115688.1, FERMT2, Del, A_7, KKNLLELHTTD, (SEQIDNO:1012); XM_542610.5, DIS3, Ins, A_7, KKNRKRGFDSFFSRSSIPHGQ, (SEQIDNO:1014); XM_003434954.4, RCOR3, Del, A_7, KKPRKRVILNNLSKLARLDLEGENIRVYNIAIILSDLSAVHLRACT, (SEQIDNO:1015); XM_005639717.2, ABCC5, Del, A_7, KKPVVHRRRNHKTRVLKQDQ, (SEQIDNO:1016); XM_003639968.3, PDZRN4, Ins, A_7, KKQENLGQLDDNPRTDDPRGQVSGWHTSS, (SEQIDNO:1017); XM_843679.5, SON, Del, A_7, KKQIVFMESGFL, (SEQIDNO:1018); XM_544621.5, RMDN3, Del, A_7, KKQRLPWRRGMRMLNVTSGMQCFVVSWLSMRASRGASRVALASRSI, (SEQIDNO:1019); XM_014115954.1, SNAPC1, Ins, A_7, KKQRNIEIRRKEDAFQKQR, (SEQIDNO:1020); XM_014112750.1, C4H1orf131, Ins, A_7, KKREARSK, (SEQIDNO:1021); XM_005630473.2, IMMT, Del, A_7, KKRFLGPNLI, (SEQIDNO:1022); XM_014109202.1, CCNE2, Ins, A_7, KKRGGRQETAV, (SEQIDNO:1023); XM_533102.5, KMT2E, Del, A_7, KKRIFQKKKIHRIRILLWIVKEQPTK, (SEQIDNO:1024); XM_533359.5, PRPF40A, Del, A_7, KKRRKANQQKKPILGIQRRKQSKHLKNY, (SEQIDNO:1026); XM_533359.5, PRPF40A, Del, A_7, KKRSKQSSYEREIGKP, (SEQIDNO:1027); XM_014120231.1, ROCK2, Ins, A_7, KKSELSNIHRESESAPETTG, (SEQIDNO:1028); NM_001003075.1, IL13RA2, Del, A_7, KKSFLIKTHSV, (SEQIDNO:1029); XM_014106344.1, PHF11, Del, A_7, KKSTEGGS, (SEQIDNO:1030); XM_847045.4, ADAMTS20, Del, A_7, KKSTYKELFLNTVVQTAQLKELIVLIGWKKKLFCRFYVWVIYTTLMYDIPSISPWKRRTT, (SEQIDNO:1031); XM_005628564.1, LOC102157031, Del, A_7, KKSYSHHNVKWKSTHGK, (SEQIDNO:1032); XM_536371.4, TET1, Ins, A_7, KKTFYSARTSFWKEEGSNDDRSSRT, (SEQIDNO:1033); XM_014110025.1, FAM175A, Ins, A_7, KKTGTNPSSTREHRKRPSGEHFSLSSFTDLFSRSRISSFMCYLLEKQAYL, (SEQIDNO:1034); XM_005619382.2, NIPBL, Ins, A_7, KKTRFLPTGGWGCYRR, (SEQIDNO:1035); XM_014122663.1, UPF2, Del, A_7, KKTRNGRKKKKKR, (SEQIDNO:1036); XM_005624831.2, TEFM, Ins, A_7, KKVPGQPALEKAHQTRNRKREA, (SEQIDNO:1037); XM_014112204.1, CAST, Del, A_7, KKVSQCLLQTLRNPWGPMMP, (SEQIDNO:1038); XM_005618261.2, ZNF518B, Del, A_7, KLAPCTVSKEAVN, (SEQIDNO:1041); XM_014106660.1 PIK3CB, Del, A_7, KLASSSTLTLDIFLEISSLNLALKGNGCLLFLPMISFM, (SEQIDNO:1042); XM_538283.5, PTPRB, Del, A_7, KLAWEQKFQ, (SEQIDNO:1043); XM_005633939.2, SUGT1, Ins, A_7, KLCCCFRNFYRRTEIR, (SEQIDNO:1044); XM_538969.5, TINAG, Ins, A_7, KLCCIMGIFYCKCGS, (SEQIDNO:1045); XM_538778.5, RAD23B, Ins, A_7, KLCGGYGDKTQSSDNTSTSYNPAVESCHHYYS, (SEQIDNO:1046); XM_014114371.1, ZNF629, Ins, A_7, KLCPQLRAAAAPESPCGWENSEESGAGEELFCPPGAPQEPPGGQALQLLRLWGLLS, (SEQIDNO:1047); XM_014115171.1, RFWD2, Ins, A_7, KLCRPRFQWRLYSLWK, (SEQIDNO:1048); XM_005626595.2, FAM13B, Del, A_7, KLDNLRNSLKGKEIASPPTVILQPIQRY, (SEQIDNO:1049); NM_001033996.2, CTSK, Ins, A_7, KLEAYFYP, (SEQIDNO:1050); XM_532881.5, RAD51AP2, Del, A_7, KLEKNRIFYNY, (SEQIDNO:1051); XM_005638171.2, UACA, Del, A_7, KLERQKESMKNHLLKSDS, (SEQIDNO:1052); XM_533429.5, TXLNB, Del, A_7, KLETQKCLKGMTKVSTPPTKSPSLLCLGGQGLMPRKSVVFTM1, (SEQIDNO:1053); XM_014118910.1, AVL9, Del, A_7, KLETSWSQPAEMLSKQEKLLASQLEELFPVQRQLC1HGFLLSPVPAPRVSLSHLTGS1, (SEQIDNO:1054); XM_005621408.2, RBBP6, Del, A_7, KLEVQKMYLIQKNPLKN, (SEQIDNO:1055); XM_537096.5, RPF1, Del, A_7, KLFHSAFQEISQI, (SEQIDNO:1056); XM_014114451.1, ZNF471, Ins, A_7, KLFPKFCGSKTQESLFRKETF, (SEQIDNO:1058); XM_014115086.1, NSL1, Del, A_7, KLFQQTHSVRFVLATMS, (SEQIDNO:1059); XM_544308.5, TAF7, Del, A_7, KLFTRQLIYVRCLSPQLMVISILLWRNQLLLLIPKQARKRIRTKRRSLYGTMELLCL, (SEQIDNO:1060); XM_014118218.1, REV3L, Ins, A_7, KLFVIYRKVK, (SEQIDNO:1061); XM_005628809.2, PTPRZ1, Ins, A_7, KLGKEVPNV, (SEQIDNO:1062); XM_005633836.2, DZIP1, Del, A_7, KLGKNRRNLYL, (SEQIDNO:1063); XM_005639425.2, TRMT10C, Del, A_7, KLGKQKRN, (SEQIDNO:1064);

XM_014108478.1, KIF21A, Del, A_7, KLGLNMKRNSKP, (SEQIDNO:1065); XM_014110047.1, BANK1, Del, A_7, KLGVDLL1, (SEQIDNO:1066); XM_005619375.2, OSMR, Ins, A_7, KLHELLRRNPSWRK, (SEQIDNO: 1067); XM_005617173.2, FBXO18, Del, A_7, KLHGIVCPCHAQDPGKPGKKRGTLCHGVLQSLENPANKWRTLV, (SEQIDNO:1068); XM_014111818.1, LOC100683280, Del, A_7, KLHLSYTN, (SEQIDNO:1069); XM_005636930.1, RPAP3, Del, A_7, KLHMYCSIT, (SEQIDNO:1070); XM_005622945.2, PSMA8, Ins, A_7, KLHRRCYSKRQ, (SEQIDNO:1071); XM_014120092.1, TEX15, Del, A_7, KLIGEFTHLCN1, (SEQIDNO:1072); XM_005628331.2, LOC611685, Del, A_7, KLIGHGKPACK, (SEQIDNO:1073); XM_014119574.1, OSBPL8, Del, A_7, KLIIQRFSGTQHQTLSSGD, (SEQIDNO:1074); XM_847173.4, LOC609830, Del, A_7, KLILLFLN, (SEQIDNO:1075); XM_535304.5, CHD9, Del, A_7, KLINPGTIKMAINSGNINWKDSTGSYSIGTIDETAF, (SEQIDNO:1076); XM_014114985.1, LOC484341, Del, A_7, KLIQGKNLMDAVNVEKPSRDLSSLDTRELTLERNHIIAVNVGKALV, (SEQIDNO:1077); XM_014113312.1, CHEK1, Del, A_7, KLIQLLLLCCIKS, (SEQIDNO:1078); XM_848169.4, KIAA2026, Del, A_7, KLIVIKKI, (SEQIDNO:1079); XM_843319.4, TMEM236, Del, A_7, KLKDGDLLW, (SEQIDNO:1080); XM_005628256.2, TMPRSS11F, Del, A_7, KLKGFYLKV, (SEQIDNO:1083); XM_005626663.2, PLIN2, Del, A_7, KLKGLIQFRNQVITLDWAPCLPSSAHVPTNRLSAGLKKPSKKAKRPFLSSIPLLI, (SEQIDNO:1084); XM_532929.5, FAM98A, Del, A_7, KLKKEAVVRSFKS, (SEQIDNO:1085); XM_005619544.1, SPATA19, Del, A_7, KLKKRLPRT, (SEQIDNO:1086); XM_005623082.2, ANKRD12, Del, A_7, KLKKSANCCVVLFLKHLSIMMNM, (SEQIDNO:1087); XM_014120026.1, WHSC1L1, Ins, A_7, KLKKTSSLQTHQS, (SEQIDNO:1088); XM_005627518.2, PHF3, Del, A_7, KLKLLLEYLVNIQIMKQKV, (SEQIDNO:1089); XM_005639568.2, PARP15, Del, A_7, KLKLSSFYLIC, (SEQIDNO:1090); XM_005638100.1, CNBD1, Del, A_7, KLKNLFVWVNLRKRSPLVRLVFFFKFLSHVL, (SEQIDNO:1091); XM_005628611.2, DNAH11, Ins, A_7, KLKQKPLCSCLLPRM, (SEQIDNO:1092); XM_531681.5, TBC1D15, Del, A_7, KLKRILIQQLW, (SEQIDNO:1093); XM_014119477.1, UTP20, Del, A_7, KLKRNSQYP, (SEQIDNO:1094); XM_005640622.2, SMARCAL1, Del, A_7, KLKRTGKRLWPVELRNY, (SEQIDNO:1095); XM_005639816.2, MASP1, Del, A_7, KLKWMRRTNPGQSNRQN, (SEQIDNO:1096); XM_014110037.1, CDK12, Del, A_7, KLLCEKSSY, (SEQIDNO:1097); XM_014120622.1, SPAG17, Del, A_7, KLLDLHLALRFGRVLTLGPNS, (SEQIDNO:1098); XM_014120363.1, PTCD3, Ins, A_7, KLLFLLHNDPRNGEAPSSCAGIKLVC, (SEQIDNO:1099); XM_014118520.1, LRP12, Ins, A_7, KLLFLPARKFSL, (SEQIDNO:1100); XM_014119702.1, CFAP54, Del, A_7, KLLFMILV, (SEQIDNO:1101); XM_014121504.1, MGAT5, Del, A_7, KLLGHPGFTTSACSESWIHLVPSQNLTMLTMPSLKATRRPGANGI, (SEQIDNO:1102); XM_537175.5, FAM20B, Del, A_7, KLLKLTWVIKGHS, (SEQIDNO:1103); XM_005637578.2, LOC486817, Del, A_7, KLLKPLTGA, (SEQIDNO:1104); XM_005634135.2, TMCO3, Ins, A_7, KLLLDVASTASFDSRCCRTRRGSKTCHQVTPRQRSGHRSEEAVGPGQLQKALWASSPKGCGS, (SEQIDNO:1105); XM_014115836.1, AKAP6, Ins, A_7, KLLLLPKSRHQEWSGCGGLVWL, (SEQIDNO:1106); XM_534311.5, DHX36, Del, A_7, KLLLVFGK, (SEQIDNO:1107); XM_845166.4, CACNG3, Ins, A_7, KLLLWLVLLFRGL1FHHRRNCGSRCRAHLYRKTSAVTCQIPLGAPEEIYLCSPSTLQV (SEQIDNO:1108); XM_005615672.2, LOC483960, Del, A_7, KLLMLKLKYWTFIILINFLKVWMGLT, (SEQIDNO:1109); XM_005636026.2, OAS2, Ins, A_7, KLLPTFSYKGSEDRQGRVDRQRHSSEDWLRCRPRRVPR1A, (SEQIDNO:1110); XM_005634563.2, ANKUB1, Del, A_7, KLLQQLGKKKSS, (SEQIDNO:1111); XM_005627518.2, PHF3, Del, A_7, KLLQQSMN, (SEQIDNO:1112); XM_532318.5, TAF2, Del, A_7, KLLVLMNTAIGLKRS, (SEQIDNO:1113); XM_542300.5, PRKRIR, Del, A_7, KLMKLLNRNPNIKK, (SEQIDNO:1116); XM_005618133.2, MEF2C, Del, A_7, KLMKNLII, (SEQIDNO:1117); XM_535769.5, UMPS, Del, A_7, KLMLRWSRE, (SEQIDNO:1118); XM_005637317.2, LOC102156193, Del, A_7, KLMNILTSGLSLLPG, (SEQIDNO:1119); NM_001287138.1, MMP12, Del, A_7, KLMQLFLTHFSIRPTSL, (SEQIDNO:1120); XM_014112389.1, MEF2A, Del, A_7, KLMRNLII, (SEQIDNO:1121); XM_532130.5, DNAH8, Del, A_7, KLMTQVHSLNWSTGNACQPNSITSSNRLKGQLVRLS, (SEQIDNO:1122); NM_001003154.2, TRDN, Del, A_7, KLNIKKKNLQL, (SEQIDNO:1123); XM_845904.4, FBXO33, Del, A_7, KLNKFSNCLKKY, (SEQIDNO:1124); XM_014113223.1, DYNC2H1, Del, A_7, KLNLMILKS, (SEQIDNO:1125); XM_536371.4, TET1, Del, A_7, KLNPNHLCQSEAF, (SEQIDNO:1126); XM_847246.3, FAM111B, Del, A_7, KLNRRVKVPLMRSVPLNSYSLRS, (SEQIDNO:1127); XM_014119762.1, LRRIQ1, Del, A_7, KLNWKTQI, (SEQIDNO:1128); XM_537144.4, NEK2, Ins, A_7, KLPAEKQTDSGHAL, (SEQIDNO:1129); NM_001005870.1, RXFP2, Del, A_7, KLPCRLQK, (SEQIDNO:1130); XM_014110285.1, PARP9, Del, A_7, KLPGYIKVLSWYWSQKDLNCPVNVYTMCCGTQDVSKSLRC, (SEQIDNO:1131); XM_005630954.2, GPR22, Del, A_7, KLPLKIVK, (SEQIDNO:1132); XM_014110821.1, DYNC1I2, Del, A_7, KLPQNMCFTAS1L, (SEQIDNO:1133); XM_014112279.1, ANKRD31, Del, A_7, KLPRKSKTIKTLHLCLVLV, (SEQIDNO:1134); XM_005615469.2, PHACTR2, Del, A_7, KLPRLLVSRPPSLHPSQQAETRPERLLVPLIQKKQLGPNHQLHHLLPPPHLVPELRRR HSLAKQGQ, (SEQIDNO:1135); XM_005620337.1, USP24, Del, A_7, KLPSLKTMNLSVSLSTVGRHMQVTTIPSLRTGGAVEKESGTSLMTQS, (SEQIDNO:1136); XM_536972.4, RSL1D1, Del, A_7, KLPTPPNSGPKSAKYPSQP, (SEQIDNO:1137); XM_005617972.2, FHADI, Del, A_7, KLQAKPRNFRSRSTALRKPSSLLCKRSCRSIWQRRRS, (SEQIDNO:1138); XM_014120239.1, SOS1, Del, A_7, KLQETMDQVIILHFRVHLPQSSGI, (SEQIDNO:1140); XM_014113297.1, GPRC6A, Del, A_7, KLQEVNISAAMNVWTVLKITTVTRQIWITASYATMKLTGPLSGAQGALKRKWNIST GMIPWLYCSWPSPY, (SEQIDNO:1141); XM_847828.4, C9H17orf78, Del, A_7, KLQGSLSSTTHTS, (SEQIDNO:1142); XM_539934.4, LMBR1, Del, A_7, KLQHGKEIWCILLLWFSSLLRHPSRSSWWMFFACWLMKQPCQREQGVLE, (SEQIDNO:1143); XM_005627580.2, DOPEY1, Del, A_7, KLQMKNSNKPVCSSATV, (SEQIDNO:1145); XM_005621271.2, RNF40, Del, A_7, KLQMRMPCGAFGRRRSRSNICSASWVLPSRKRKLCCQRWM, (SEQIDNO:1146); XM_003433767.3, DIMT1, Ins, A_7, KLQNPLFAP, (SEQIDNO:1147); XM_014115338.1, ASHIL, Del, A_7, KLQRETMDN, (SEQIDNO:1149);

XM_014117442.1, LOC102156332, Del, A_7, KLQRIIVPRR, (SEQIDNO:1150); XM_005638476.2, VPS13C, Del, A_7, KLQRPQMRSSLIFY, (SEQIDNO:1151); XM_014106605.1, GOLGA4, Del, A_7, KLQRRK-MIYKEQPKDMKKSLMLVKKK, (SEQIDNO:1152); XM_005615672.2, LOC483960, Del, A_7, KLQRYL-VLELTM, (SEQIDNO:1153); XM_005616781.2, ZNF507, Ins, A_7, KLQSGPSQYGVLCFTLLLLYLWLRIYQQRK-SPGSYERA, (SEQIDNO:1154); XM_014119322.1, MACF1, Del, A_7, KLQTDNPGSRTVCKKLRNIS-GMFKTSCHG, (SEQIDNO:1155); XM_014107150.1, SYCP2, Ins, A_7, KLQTIEDYFC, (SEQIDNO:1156); XM_005622441.2, SWT1, Del, A_7, KLQVLVQFAV, (SEQIDNO:1157); XM_014120087.1, LOC607729, Ins, A_7, KLQWTWDLQ, (SEQIDNO:1158); XM_005623940.2, TDRD9, Ins, A_7, KLRDSEKAYC, (SEQIDNO:1159); XM_005615947.1, LOC102155374, Ins, A_7, KLRGSLVQEIGTDQ, (SEQIDNO:1160); XM_014121223.1, CCDC73, Del, A_7, KLRKFQYM, (SEQIDNO:1161); XM_003638871.2, PTCHI, Ins, A_7, KLRQVLGCGPPHIWGLRCGIKGS, (SEQIDNO:1162); XM_005615403.2, RNMT, Ins, A_7, KLRRRTQFSSGCPL, (SEQIDNO:1163); XM_005630615.2, PIP5K1A, Ins, A_7, KLRRSGTRFYQFGDPKKPAM1, (SEQIDNO:1164); XM_005622349.2, PPP2R5A, Del, A_7, KLRSLFLSRYPSVYPVLIFRLQKGHCTSGIMSIFLV, (SEQIDNO:1165); XM_845578.4, PALB2, Del, A_7, KLRSLKITQV, (SEQIDNO:1166); XM_014108413.1, PLEKHA5, Del, A_7, KLRTFFPKRSSNLNQME, (SEQIDNO:1167); XM_014107378.1, NBEA, Del, A_7, KLSIACLGLE, (SEQIDNO:1169); XM_003435003.3, LAMA3, Del, A_7, KLSISTQLK, (SEQIDNO:1170); XM_005619370.2, C9, Del, A_7, KLSKRRHQILKQI, (SEQIDNO:1171); XM_539474.5, IGF2BP3, Del, A_7, KLSKTLTLKSQFLHCRN, (SEQIDNO:1172); XM_851151.4, NFASC, Del, A_7, KLSLLRARSSPYS, (SEQIDNO:1173); XM_534417.5, BPI, Del, A_7, KLSLRSERP, (SEQIDNO:1174); XM_005638943.2, NDUFV3, Del, A_7, KLSLTPQSQDC1-HSQMSAQQLGNRQKEPKRQDSCKHLLIPEKDILK-SKYWKVTGRW HFPYPTRKMQGSR, (SEQIDNO:1175); XM_014111818.1, LOC100683280, Del, A_7, KLSPPVLHTCLLFPLHTAAVFSSISSLRPKKR-WISIKGYPCSLHLLLLC, (SEQIDNO:1176); XM_005627395.2, XPO5, Del, A_7, KLSQCWRQRCWTIRRAAWPPSLNP, (SEQIDNO:1177); XM_535945.5, NOSTRIN, Ins, A_7, KLSRQCLGLGLR-GHEVSGGPTSKTWQSN, (SEQIDNO:1178); XM_545261.4, NMD3, Del, A_7, KLSTIWNS, (SEQIDNO:1181); XM_845588.3, BRE, Ins, A_7, KLSVQPQMGWK, (SEQIDNO:1182); XM_005624045.1, DNAH17, Del, A_7, KLSVSWER, (SEQIDNO:1183); XM_014115969.1, PPPIR36, Ins, A_7, KLTGKTIQK-LYGGPCREKRDGIGYK, (SEQIDNO:1184); XM_005623485.2, SYNE2, Del, A_7, KLTM-NYTDYKHFSSICSVITEIRIS, (SEQIDNO:1185); XM_005628611.2, DNAH11, Del, A_7, KLTPSINS1, (SEQIDNO:1186); XM_005623378.2, KLHDC2, Del, A_7, KLTQKEMFLLPCQEAVLCV, (SEQIDNO:1187); XM_005621408.2, RBBP6, Del, A_7, KLTTITESTQVPN-VEMKGMN, (SEQIDNO:1189); XM_014108105.1, FGFI, Ins, A_7, KLVCWSQEEWKLQTRSSDSLWSKSNFVSP-PASVL, (SEQIDNO:1190); XM_535783.4, ATP13A3, Del, A_7, KLVFSVLVPKG, (SEQIDNO:1191); NM_001005869.1, HTR2A, Ins, A_7, KLVGSVDS-GRDYSDHCWKHTRHHGSVPREKAAER-HQLFPDVTCHS, (SEQIDNO:1192); XM_547945.4, PTPN21, Del, A_7, KLVLSSWLP, (SEQIDNO:1193); XM_014121598.1, MKRN2, Del, A_7, KLVNTL-SKARGPAHLEANAFTATLTLTGGWQSLRSPGSSSVL-RAP, (SEQIDNO:1194); XM_014108855.1, CC2D2B, Del, A_7, KLVRRCFPTEESQLLSLIVKGYRS, (SEQIDNO:1195); XM_014118218.1, REV3L, Del, A_7, KLVSNKGQIVKILKELCLLGENDHMLSCLLPHHLT-TLKPKTVT, (SEQIDNO:1196); XM_014109172.1, PRKDC, Ins, A_7, KLVSPAKNTLR, (SEQIDNO:1197); XM_005637209.2, CIR, Del, A_7, KLWGGSVGSWVLHWATPQKQGNSCLKGTRCS, (SEQIDNO:1198); XM_005627781.1, AIM1, Ins, A_7, KLWIQRFQY, (SEQIDNO:1199); XM_014121650.1, MYO3A, Del, A_7, KLWNLVLAKSQFIKTQIARKRRHL, (SEQIDNO:1200); XM_005628783.1, LOC100856700, Del, A_7, KLWPPALPI, (SEQIDNO:1201); XM_014109144.1, LOC607941, Ins, A_7, KLWTSEGDG-GAGPAPGGQ, (SEQIDNO:1203); XM_014113138.1, C4H5orf42, Del, A_7, KLYGIKHN, (SEQIDNO:1204); XM_014114250.1, ZKSCAN5, Del, A_7, KMAFVRKH-IVGT, (SEQIDNO:1205); XM_005641533.2, HDX, Del, A_7, KMAKHKLF, (SEQIDNO:1206); XM_014108953.1, ZNF518A, Del, A_7, KMCHLCQHQNWLQHQ, (SEQIDNO:1207); XM_005617406.2, GPBP1, Del, A_7, KMDGGCMEEMVLKT, (SEQIDNO:1208); XM_014109460.1, ZNF280D, Del, A_7, KMD-VIQIHLKAH, (SEQIDNO:1210); XM_014115228.1, RGS7, Del, A_7, KMEFLFVLSKAFFPRY-LASSLGQTLFSG, (SEQIDNO:1211); XM_539311.4, ADAMTS3, Del, A_7, KMEGFMLSTRDQP, (SEQIDNO:1212); XM_014122056.1, FBXO15, Del, A_7, KME-KNTSCSTLTF, (SEQIDNO:1213); XM_005619169.2, NSD1, Del, A_7, KMEMALRNQYVLALVGVTLHCLE-NYLYLYLA, (SEQIDNO:1214); XM_014109744.1, SCAF4, Del, A_7, KMEYSK-LKLSSPFWTWLQEPVMLPQ, (SEQIDNO:1215); XM_005640584.2, ZDBF2, Del, A_7, KMFIWKTKTVNMVK, (SEQIDNO:1216); XM_014114455.1, TRMT13, Del, A_7, KMFQRSG-PLWLALLLHSVVTTGVIGDIMWAKSISGL, (SEQIDNO:1217); XM_014120493.1, SPDYA, Del, A_7, KMHIIPTSLNAPKDPV, (SEQIDNO:1219); XM_005637882.2, FAM160B1, Del, A_7, KMIGHLHLL-FLYKKILFITGRQLPITT, (SEQIDNO:1220); XM_014112349.1, BOD1L1, Del, A_7, KMILKPHI, (SEQIDNO:1221); XM_546816.3, PKD1L2, Del, A_7, KMIS-CRKKERLLICY, (SEQIDNO:1222); NM_001003379.1, CD3E, Del, A_7, KMITLWKVLVTESYLRRSFQKWTTV-VIMPAMQIP, (SEQIDNO:1223); XM_014106549.1, ZBTB38, Del, A_7, KMKKGMKNLQSPMGQGSQMHFPSSKQKIV-ITCFLHWT, (SEQIDNO:1224); XM_014109295.1, LRRCC1, Del, A_7, KMKKITLSVVYQGTE-QLCSRHCHSLES, (SEQIDNO:1225); XM_532888.5, ATAD2B, Del, A_7, KMKKTPNLQTMRTIRRTGSC, (SEQIDNO:1226); XM_850315.4, IL7R, Del, A_7, KMKMT-GRV, (SEQIDNO:1227); XM_014108110.1, SPECC1L, Del, A_7, KMKNSQKNWRK, (SEQIDNO:1228); XM_014112182.1, AHI1, Del, A_7, KMKQNSSQRHLLLPPPSASMG, (SEQIDNO:1229); XM_005627935.2, KIAA0196, Del, A_7, KMKTYKLGS-ERSQNKSCL, (SEQIDNO:1231); XM_003433082.3, NUDT15, Del, A_7, KMKVGSGFPGKN-FLPWTSFSGYCDV, (SEQIDNO:1233); XM_014109687.1, SYNJ1, Del, A_7, KMLDRFLEDF, (SEQIDNO:1235); XM_014112214.1, KIAA0825, Del, A_7, KMLKNYWKKYLYH, (SEQIDNO:1237);

XM_535180.5, HSPA14, Del, A_7, KMLLGKQPELLGLMFCG, (SEQIDNO:1238); XM_547651.5, THOC1, Del, A_7, KMLLLGNQIHSILLG-KIIYYVCAM15, (SEQIDNO:1239); XM_005629547.2, AGK, Del, A_7, KMLPRFYTYLAWM, (SEQIDNO:1241); XM_014111866.1, CXHXorf58, Del, A_7, KMLPWGLNHKRTNQAQSNNSQSSSLPHLLTL, (SEQIDNO:1242); XM_014113467.1, CEP126, Del, A_7, KMLQIVLC, (SEQIDNO:1243); XM_003639701.3, NIFK, Del, A_7, KMLQTLVLRSLQIARSCRKRRRRRRRVHVLLPLLRRP-WIARAPHQFVHQHFWRNEN LKQLK, (SEQIDNO: 1244); XM_532014.5, LOC612942, Del, A_7, KMMDYSIDQM, (SEQIDNO:1245); XM_014109909.1, ANK2, Del, A_7, KMMRQSLQKHLS, (SEQIDNO:1246); XM_535747.5, GAP43, Del, A_7, KMMRTKRLNK-MASNQKIKLIRPRPKFRLASVDT, (SEQIDNO:1247); XM_005638097.2, RMDN1, Del, A_7, KMNPVLQLIS-GMQSVLVMLEIMKASRLKLQMPTLSRSILRKQLN, (SEQIDNO:1248); XM_545669.5, SCG2, Del, A_7, KMNRSTTK, (SEQIDNO:1249); XM_014113355.1, LOC106558787, Del, A_7, KMNRVTLMVWGGML-SPSLLGSGLFLWCMIPTGR1, (SEQIDNO:1250); XM_014113356.1, LOC106558787, Del, A_7, KMNRVTLMVWGGMLSPSLLGSGLFLWCMIPT-GRYFLH, (SEQIDNO:1251); XM_014113357.1, LOC106558787, Del, A_7, KMNRVTLMVWGGML-SPSLLGSGLFLWCMIPTGSATRHLLMNLAQLCS-LYTSMQPN AILTYF, (SEQIDNO:1252); XM_014119696.1, MRPL42, Del, A_7, KMNTLSKDS, (SEQIDNO:1253); XM_544601.6, ARHGAP11A, Del, A_7, KMPSFPYHPQFLHQMLSVNCQWILL-MVSQVRRGSPSSTILTLNSCQLIFSVAVLRQY QFPLI-QAQKGHLRIHSLLSPSMETI, (SEQIDNO:1254); XM_536013.5, GTF3C3, Del, A_7, KMQKKELQKRIKLVRMLPAVYLMVCQ, (SEQIDNO: 1255); XM_014111854.1, ATP7A, Del, A_7, KMQLLFMTLNYRLQRPYWKLLMTWALMLFSTILILSLF, (SEQIDNO:1256); XM_005640594.2, PIKFYVE, Del, A_7, KMQTLLLIQRKHLLWQAADQEAKLRVMKRKG, (SEQIDNO:1257); XM_003434003.1, DSPP, Del, A_7, KMQTRRQE, (SEQIDNO:1258); XM_005630416.1, BUB1, Del, A_7, KMQVLLGLGESIRSSPLCHLLFLCLK-METKKIMDYHSLKINPQEPGPLENAL, (SEQIDNO: 1259); XM_005617569.2, CYLD, Del, A_7, KMRKLE-FLQFSSY, (SEQIDNO:1260); NM_001168012.1, CCDC66, Del, A_7, KMRLFHLSWMKINPL, (SEQIDNO: 1262); XM_531828.5, RTN4, Del, A_7, KMRLLMSRMKLDHYLAQSYPMTFLSR1, (SEQIDNO:1263); XM_014117467.1, VPS13A, Del, A_7, KMRLNFFIKI, (SEQIDNO:1264); XM_014116764.1, ATAD5, Del, A_7, KMRNRKICWIA, (SEQIDNO:1265); XM_535474.5, USP8, Del, A_7, KMRPQRKGQSQQRSCIQ, (SEQIDNO:1267); XM_005615794.2, ZCCHC6, Del, A_7, KMRQIALWV, (SEQIDNO:1268); XM_014111472.1, CYLC1, Del, A_7, KMRRKRMPRRMKCPLM-LILNLNGIQKRVNKMKKRIREFQKKTKINLQ, (SEQIDNO:1269); XM_005633939.2, SUGT1, Del, A_7, KMRSWREMQL, (SEQIDNO:1270); XM_539955.5, PLAT, Del, A_7, KMRTATLEKG, (SEQIDNO:1271); XM_014120778.1, CACNA2D1, Del, A_7, KMRVSQAARG, (SEQIDNO:1272); XM_014113435.1, RDX, Del, A_7, KMSALRSNSRH, (SEQIDNO:1273); NM_001048021.1, ABCG2, Del, A_7, KMSELTRSFSN, (SEQIDNO:1274); XM_005621835.2, WDR47, Del, A_7, KMSFEIQQNSFKNIIGKDYAINSI, (SEQIDNO:1275); XM_014117434.1, IL1R1, Del, A_7, KMSFPKYSGIR-IANLCFLTI, (SEQIDNO:1276); XM_014116249.1, LOC609770, Del, A_7, KMSQIFRKLETTLKLL, (SEQIDNO:1278); XM_014121779.1, NISCH, Del, A_7, KMSQPFRPEK, (SEQIDNO:1279); XM_014111702.1, TAF7L, Del, A_7, KMSSSFPYGNN, (SEQIDNO:1280); XM_014107151.1, SYCP2, Del, A_7, KMSST-TLITRTLFFDLRCVQ, (SEQIDNO:1281); XM_005619749.1, NXPE4, Del, A_7, KMSSVSPNATH, (SEQIDNO:1283); XM_005638190.2, CHRM5, Del, A_7, KMTMTPKNTSCPQVLLIDPRVRNVWPISSNWW, (SEQIDNO:1284); XM_532129.4, GLO1, Del, A_7, KMTSQKIKMKK, (SEQIDNO:1285); XM_005636950.2, SCAF11, Del, A_7, KMTSVQMLLMIQILPTNI-EMTVPVG, (SEQIDNO:1286); XM_846278.4, MAP4K5, Del, A_7, KMVATTSSVISGQWE, (SEQIDNO:1287); XM_005640267.2, XIRP2, Del, A_7, KMVFLHHCPQR, (SEQIDNO:1288); XM_545075.4, ADGRG7, Del, A_7, KMVITPFRWTLMLMKCSRKIFMTSGIPRALWLLPCC-TISFW, (SEQIDNO:1289); XM_005633870.2, SETDB2, Del, A_7, KMVMQKLSGWIWKMMEKWT-SYLNKCKMCCNH, (SEQIDNO:1290); XM_847551.4, SLC25A13, Del, A_7, KMVSFLCLPMTSSHDI, (SEQIDNO:1291); XM_014119574.1, OSBPL8, Del, A_7, KMVSGLEQFF, (SEQIDNO:1292); XM_003640020.3, MRPL15, Del, A-7, KMVVLLLLQLSMIQEV, (SEQIDNO: 1293); XM_532130.5, DNAH8, Ins, A_7, KNICFK-PIWTKTIRRCYFLYKN, (SEQIDNO:1295); XM_014113470.1, CEP126, Del, A_7, KNLNMNIIV, (SEQIDNO:1296); XM_014119939.1, ZNF786, Ins, A_7, KNNERRIALPATSDF, (SEQIDNO:1298); XM_536224.5, WHSC1, Ins, A_7, KNPHKEDTGAY, (SEQIDNO:1299); XM_014111407.1, DOCK11, Ins, A_7, KNPTQKAPGSQARAGGKDQNC, (SEQIDNO:1301); XM_005624991.1, MED13, Ins, A_7, KNSKALGSSRSSH-LATVS, (SEQIDNO:1302); XM_014110851.1, EIF4G3, Del, A_7, KNSLLKSYISDSRNSLLRTRRMMNRSLTG, (SEQIDNO:1303); XM_542340.5, AKIRIN2, Del, A_7, KNSPYLLYDRLG, (SEQIDNO:1304); XM_014111650.1, GPRASP1, Del, A_7, KNTGFGLEKRLITCQGPN-PRKRPGPE, (SEQIDNO:1305); XM 005624024.1, CCDC40, Del, A_7, KPAKSSRRKSSLWGHNTTFD, (SEQIDNO:1306); XM_014119962.1, RNF32, Del, A_7, KPALSVEGTSIKPE, (SEQIDNO:1307); XM_005629416.2, STIL, Ins, A_7, KPAMLFTWFSHSR, (SEQIDNO:1308); XM_859168.4, SLTM, Del, A_7, KPARLLKRKEAIQIILN, (SEQIDNO:1309); XM_005615470.1, PHACTR2, Del, A_7, KPASSQPL-DRPQMQPPLARLT, (SEQIDNO:1310); XM_005626529.2, AFF4, Ins, A_7, KPAWIRTLQITLFQPWKTPGCFFIEL, (SEQIDNO:1311); XM_854588.4, CNOT4, Ins, A_7, KPCLC-CRTVSAPSRSRGFETTRIFWEVW, (SEQIDNO:1312); XM_005618098.2, TTC37, Ins, A_7, KPCTKDHSESSSFSR, (SEQIDNO:1313); XM_003639778.2, CCDC105, Ins, A_7, KPEGAAR-HAQEPHREPQLQEDRV, (SEQIDNO:1314); XM_005632154.2, ATG7, Ins, A_7, KPERRHGTEDGEPQ, (SEQIDNO:1315); XM_843302.3, COR6C33, Del, A_7, KPFLHAPLI, (SEQIDNO:1316); XM_844234.4, TAF1, Del, A_7, KPFLLTQKVASARG, (SEQIDNO:1317); XM_014118021.1, MCHR2, Del, A_7, KPFLT-FISATWLWLIWSTSLECHFLFISGPGEESGCLGGPSAP-LSHPWIPATSLPVVPS, (SEQIDNO:1318); XM_014111411.1, LOC611589, Del, A_7, KPFQRSE-QLIFWIFLLGSSCLLSQEATMYSILRI, (SEQIDNO: 1319); XM_005619571.2, KIRREL3, Del, A_7, KPGLDCPGEQISKGLCQPRMTSEWRSSTRSQPLVER- LRNTPPSSS, (SEQIDNO:1320); XM_005631628.2, ASRGL1, Ins, A_7, KPGNCGCRCLGLQRKRGLCNLDGWHR, (SEQIDNO:1321); XM_546237.5, SH3PXD2B, Del, A_7, KPHLPGPSRRSEGHSGKQVKAKQLLLQAGPYWSLLKPNLFFPTPQAATMTCEAKVV WDRGWWAK, (SEQIDNO:1322); XM_014112906.1, USP54, Ins, A_7, KPHPFASTLEPRHRAGDFRIGVSLPSQSSDFSSWLFWMGAARCGLALIKPNRIHQMR GKSLWKPG TVVPAPLPSLSSM, (SEQIDNO:1323); XM_014112904.1, USP54, Ins, A_7, KPHPFASTLEPRHRAGDFRIGVSLPSQSSDFSSWLFWMGAARCGLALIKPNRNFEECP AVSGYV, (SEQIDNO:1325); XM_534366.4, PTPRA, Ins, A_7, KPICKH1A1, (SEQIDNO:1326); XM_005628165.2, CORIN, Del, A_7, KPILNLTGVSLWSPMVKSQCLRLFLQIQSVTRAPQHRLHIPVNTFQPGPRMLLSQGTK ITGTQVPV, (SEQIDNO:1327); XM_014119437.1, CEP290, Del, A_7, KPKALLILNSLYDKQQRGNKKLRNTRKTSSNRLRFSNMFLKVLRQSKAFNESFKF, (SEQIDNO:1328); XM_545071.5, DCBLD2, Del, A_7, KPKAPMTYLTGTGQVGGKE, (SEQIDNO:1329); XM_005636930.1, RPAP3, Del, A_7, KPKMKTQKTG, (SEQIDNO:1330); XM_005623780.2, AK7, Del, A_7, KPKNSRLMWLLLDFNME, (SEQIDNO:1331); XM_005626210.1, PKDREJ, Del, A_7, KPKPVTRTQKTIKIKMPNLSL, (SEQIDNO:1332); XM_014122498.1, NUMA1, Ins, A_7, KPKTSLFSGMPSVRAEGNRGVRAGIGQDDYAALIPLHHELQKSQGLGTIRI, (SEQIDNO:1333); XM_005622017.2, PRKACB, Del, A_7, KPLEQVHLEESCW, (SEQIDNO:1334); XM_003639939.3, COPS7A, Del, A_7, KPLKLQQPQLPRLHLRTLSST, (SEQIDNO:1335); XM_850195.4, C4H5orf34, Del, A_7, KPLKSFRILTIFYQILKS, (SEQIDNO:1336); XM_531828.5, RTN4, Del, A_7, KPLLIQNKRTDHHLLYFQQS, (SEQIDNO:1337); XM_014117890.1, SMC2, Del, A_7, KPLRKVRRP, (SEQIDNO:1338); XM_548321.5, TSR1, Ins, A_7, KPLSRPVQFGEW, (SEQIDNO:1339); XM_014117962.1, LOC102153482, Ins, A_7, KPLSYFERNVATV, (SEQIDNO:1340); XM_005618961.2, DDX50, Ins, A_7, KPLTKGSCFGSYKGTGKPSSQRLQRYH, (SEQIDNO:1341); XM_014118588.1, CSMD3, Ins, A_7, KPLVESSTSNL, (SEQIDNO:1342); XM_850281.4, POLE3, Del, A_7, KPMQRSKTRAEMRTTMKTKNGWKKKNRTKRRK, (SEQIDNO:1343); XM_014118452.1, GLTSCR1L, Del, A_7, KPNASAEH, (SEQIDNO:1344); XM_014121964.1, ARHGAP12, Ins, A_7, KPNDLSEYSNCFWSHSVKARERDW, (SEQIDNO:1345); XM_014109318.1, TRIQK, Del, A_7, KPNLFYEQPN, (SEQIDNO:1346); XM_539422.5, SAMD9L, Ins, A_7, KPNSKPSLSKSV, (SEQIDNO:1347); XM_535063.5, MCM4, Del, A_7, KPPLKISSCLTRYYQGLI, (SEQIDNO:1348); XM_005622209.2, KDM5B, Del, A_7, KPPMLWICMSASCVAVATMKTGFSCVMGVTTVTTPFA, (SEQIDNO:1349); XM_005637095.1, PLCZ1, Ins, A_7, KPPRIFETRTVCT, (SEQIDNO:1350); XM_014119556.1, EEA1, Ins, A_7, KPQLTGTSNSTNREAEESVRKP, (SEQIDNO:1351); XM_014119166.1, LRGUK, Del, A_7, KPQWKEILWRDNMRQPGRP, (SEQIDNO:1352); XM_005615889.2, DOCK8, Ins, A_7, KPRKFGD1R1, (SEQIDNO:1354); XM_005637524.2, SLC16A12, Del, A_7, KPSCGSLPKNLIRSCSSGPMDRWLIL, (SEQIDNO:1355); XM_014107870.1, GLT1D1, Ins, A_7, KPSDGESPRGSQIRCRFHRINEGDGANAVAACQG, (SEQIDNO:1356); XM_014110190.1, SENP5, Del, A_7, KPSEAGCRSLGTIKRPLGKTVRVA-IAAHSLPQNLKTLLVSINRTFQIWTAMLW, (SEQIDNO:1357); NM_001168012.1, CCDC66, Del, A_7, KPSGRKSLMNRLL, (SEQIDNO:1358); XM_014111292.1, RGS2, Del, A_7, KPSHPKSCPPKQGKYILIS, (SEQIDNO:1359); XM_547384.2, IL19, Del, A_7, KPSKLRTPSKMSPSCPHRRPCIALSPQTYAA, (SEQIDNO:1360); XM_005642434.2, LOC100686288, Del, A_7, KPSLCIEILFDIRVFILVGNFLDVRNVRRPIVLAQTLFSIRKFILVGSPMTVGNVGRPLV GLQTLFNMREFILN, (SEQIDNO:1361); XM_014111020.1, INO80D, Del, A_7, KPSLLHLPKNIRKREGVDLVDPKNPFPLQCPKETSACPPASHCQWRLPRSGARPRQS, (SEQIDNO:1362); XM_014121789.1, UNC13A, Del, A_7, KPSLMVPKRNSTHT, (SEQIDNO:1363); XM_003431606.1, LOC100685645, Del, A_7, KPSPLLDVLFRCLPPTLWGPQSVCS, (SEQIDNO:1364); XM_014109144.1, LOC607941, Del, A_7, KPSRRIASGRSGLSW, (SEQIDNO:1367); XM_014119477.1, UTP20, Ins, A_7, KPSSPYSGPTPSTPELSSAAPNSSARWAESCCEQENQHAHIY, (SEQIDNO:1369); XM_014114304.1, LOC479758, Del, A_7, KPSSRSPTSLNTREHTLGRSPMNVTNVGNHSVISQP, (SEQIDNO:1370); XM_014119418.1, CHD8, Ins, A_7, KPSTQTGNYH, (SEQIDNO:1371); XM_005630719.2, POLR3C, Del, A_7, KPSVCLSNITW, (SEQIDNO:1372); XM_005640279.2, NOSTRIN, Ins, A_7, KPSWLCCQTEVGKYPGKLLPEYPGAGEGKN, (SEQIDNO:1373); XM_014118492.1, TDRD6, Del, A_7, KPTLILHSFLTGISQR, (SEQIDNO:1374); XM_014110645.1, ELOVL2, Del, A_7, KPVRLLFFTCTTMPLCLTSGGVF, (SEQIDNO:1375); XM_005634561.2, RNF13, Del, A_7, KPVRSASKKWFLPKATQTPTQTAVKKKMRCPNTPLFLDLWLLSAPSHLGLCRNLAH IRI, (SEQIDNO:1376); XM_005626337.2, SEMA6A, Del, A_7, KPVSPPETHTVGG, (SEQIDNO:1377); XM_005629247.2, USP44, Del, A_7, KPVTPQVNEGQ, (SEQIDNO:1378); XM_014121139.1, APIP, Ins, A_7, KPVYSSFYECIHNERSRCSDSYSL, (SEQIDNO:1379); XM_014112831.1, CTNNA3, Del, A_7, KPWKCTSIHGRIISMSSLKL, (SEQIDNO:1380); XM_005640528.2, FAM126B, Del, A_7, KPWYQLSIKSFRIRIMSFWNLSATSCLSSIVALKFDLRGSHCSSCQN, (SEQIDNO:1381); XM_014112420.1, TICRR, Ins, A_7, KPYRSDPWQTGHF, (SEQIDNO:1382); XM_005627271.2, PNPLA1, Del, A_7, KQAAKCSLLPVPSTSLCSPLPRQFGSPTGLIPARSRNTAVLRKL, (SEQIDNO:1383); XM_005619653.2, C5H11orf63, Ins, A_7, KQADFGITYS, (SEQIDNO:1384); XM_005639155.2, PTPN13, Del, A_7, KQAFLMQQITLTVEIQTWMKLLIPAVRIIKHQKREV, (SEQIDNO:1385); XM_014109969.1, PTPN13, Del, A_7, KQAFLMQQITLTVEIQTWMKLLIPAVRIIKHQKRNLPPQ, (SEQIDNO:1386); XM_531673.4, YEATS4, Del, A_7, KQALKLQSLRRD, (SEQIDNO:1387); XM_005634418.2, ATP2Cl, Del, A_7, KQANYQSVKLQAFSKLIFRMV, (SEQIDNO:1388); XM_535238.5, DHX29, Ins, A_7, KQARPKRGSRKNKEISKRNGNFRRPSSIQSSHKDFTSTE, (SEQIDNO:1389); NM_001002968.1, SLC10A2, Ins, A_7, KQCGISREQRQRNGL, (SEQIDNO:1390); XM_844191.4, KCNT2, Ins, A_7, KQCIKVILSWTFSITCT, (SEQIDNO:1391); XM_005621555.2, ATF7IP2, Del, A_7, KQCLQVAGSK, (SEQIDNO:1392); XM_014115116.1, CACNA1E, Ins, A_7, KQDGGERPGMEAP, (SEQIDNO:1393); XM_014109954.1, CCDC158, Ins, A_7, KQDGWRTRSPEITGTPFERKGC, (SEQIDNO:1394); XM_005633481.2, WNT11, Del, A_7, KQDPKPIN, (SEQIDNO:1396); XM_005619375.2, OSMR Del, A_7, KQDTPRSWLLRTTLEWS, (SEQIDNO:1397); XM_003639330.3, CCT4, Del, A_7, KQDVMSSSYRSLS, (SEQIDNO:1398); XM_537686.5, COIL, Ins, A_7, KQEEKQSHV, (SEQIDNO:1399); XM_014112131.1, LOC100688660, Ins, A_7, KQEENRGRKCCQKGR-GASGF, (SEQIDNO:1401); XM_005620337.1, USP24, Ins, A_7, KQEGWIQVISA, (SEQIDNO:1402); XM_003435066.3, TRAF3, Ins, A_7, KQEHTKFAQSDM, (SEQIDNO:1403); XM_850902.4, G3BP2, Del, A_7, KQELQESEKPEVVVMIAGILGAMIEVLVVHVA, (SEQIDNO:1404); XM_534297.5, U2SURP, Ins, A-7, KQFGTLQRRIETNSGRA, (SEQIDNO:1405); XM_005627588.2, CEP162, Ins, A_7, KQFIGRHQKTEAR (SEQIDNO:1406); XM_014114222.1, ZCWPW1, Del, A_7, KQFRLILRSETSKEEKEVILANVLFGSSAP-LQTVRSGGGFVETLTLQCFQMIGPVIRIQ T, (SEQIDNO:1407); XM_535242.6, PLK2, Del, A_7, KQFTIMQSLASALFSQQQMLLNNSLVK, (SEQIDNO:1408); XM_003639390.3, TLN1, Ins, A_7, KQGSFWAG-GRRGVYY AGGLSFPQKVDSPPAAV, (SEQIDNO:1409); XM_005640790.1, LEMD1, Ins, A_7, KQGTQKKPSF, (SEQIDNO:1410); XM_003434330.2, LEMD1, Ins, A_7, KQGTQKKTRGFQH, (SEQIDNO:1411); XM_014108953.1, ZNF518A, Del, A_7, KQHYIESVKKSLNLKMPVNHLD-LTDQGFQKIQSELCGFSLLVPNS1, (SEQIDNO:1412); XM_014109172.1, PRKDC, Ins, A_7, KQHYSK-VAPGFQSFS, (SEQIDNO:1413); XM_014111106.1, ALS2CR11, Del, A_7, KQICQIIVRGLIEKKMI, (SEQIDNO:1414); XM_014121388.1, IWS1, Ins, A_7, KQIC-TRSENQHRGQ, (SEQIDNO:1415); XM_014110764.1, KCNH7, Ins, A_7, KQIFIFHLLH, (SEQIDNO:1416); XM_014118880.1, LOC482344, Del, A_7, KQIHVKGI, (SEQIDNO:1417); XM_014119627.1, ANO4, Ins, A_7, KQIKWTLLQRWKVSD, (SEQIDNO:1418); XM_861118.4, PTPRE, Ins, A_7, KQISQHPSQ, (SEQIDNO:1419); XM_005628464.2, DBF4, Ins, A_7, KQNEIYEN, (SEQIDNO:1420); XM_005620331.2, C5H11orf141, Del, A_7, KQKDISASKMSLNLERVILES, (SEQIDNO:1421); XM 005640597.2, MAP2, Del, A_7, KQKFRPTLPPGNSF, (SEQIDNO:1422); XM_533539.4, KIAA0020, Ins, A_7, KQKHQQRNRNAT, (SEQIDNO:1423); XM_014115681.1, RALGAPA1, Ins, A_7, KQKHRIDHTIFCYLYSRSDISCINKNAF, (SEQIDNO:1424); XM_014112733.1, ARID4B, Del, A_7, KQKKMKI-WRIKMRRQLVWMNPSA, (SEQIDNO:1426); XM_014118258.1, OGFRL1, Del, A_7, KQKKQLKDSS-WPIR, (SEQIDNO:1427); XM_531833.5, PPP4R3B, Del, A_7, KQKKVKTRKTFLKGHHLVASNLHSPTLPVLL-MEQIVQTVSL, (SEQIDNO:1428); XM_014115508.1, CEP192, Del, A_7, KQKLVDJMKVDWKTFQELVRLIFGNLCPKNRLHKT-SIQWT, (SEQIDNO:1429); XM_014110297.1, POLQ, Del, A_7, KQKMFVWNILSHDPKVKK, (SEQIDNO:1430); XM_541863.4, IQCF2, Del, A_7, KQKQPQRFRPGGV APSYAGHCCTQLSVPGSFSAGGG, (SEQIDNO:1432); XM_005641869.2, MAP7D3, Del, A_7, KQKRREAR1, (SEQIDNO:1433); XM_858323.4, EIF2S2, Del, A_7, KQKRYLILMKLKKV, (SEQIDNO:1434); XM_542579.5, CCDC122, Ins, A_7, KQKSSITFAE, (SEQIDNO:1435); XM_005623784.2, PAPOLA, Del, A_7, KQKTLKISVLIS-PMIFSLSQIQFIGKQ, (SEQIDNO:1436); XM_844661.3, RGS21, Del, A_7, KQKVQKKLLLKPR, (SEQIDNO:1437); XM_005615470.1, PHACTR2, Del, A_7, KQLGPNHQLHHLLPPPHLVPELRRRHSLAKQGQ, (SEQIDNO:1439); XM_005620305.1, KMT2A, Ins, A_7, KQLGPRPNCPIPGEGENPLPFHSFI, (SEQIDNO:1440); XM_014115880.1, MIS18BP1, Del, A_7, KQLKLIFQLQHQEKKPCLTKN, (SEQIDNO:1442); NM_001003222.1, CNGA1, Del, A_7, KQLMRKKSSSIY-LIS, (SEQIDNO:1443); XM_862810.4, NUMB, Del, A_7, KQLRQSCGYQQMDSELWMKKLRTS, (SEQIDNO: 1444); XM_014117096.1, ZNF510, Del, A_7, KQLSLTVKELG, (SEQIDNO:1445); XM_014113138.1, C4H5orf42, Del, A_7, KQLSRRNGQKL, (SEQIDNO: 1446); XM_539701.5, TMTC2, Del, A_7, KQLSWTAR-SLMWSSVLPTCSDRLASTKPPRSIMIWQPD, (SEQIDNO:1447); XM_014111218.1, ZC3H11A, Del, A_7, KQLWQLFHSFLRTSQSLCPRWKNLETVMC-CLQPSLLQTPLHRKSLALLHPK, (SEQIDNO:1448); XM_014115168.1, LOC480059, Del, A_7, KQMNLLISS-WLKSWR, (SEQIDNO:1450); XM_534832.5, PUS7L, Del, A_7, KQNLIFKIYPVKRAATKKSILSPSALMMTKI-ISLVQKRKILSMMELPKVKKKKFMF, (SEQIDNO: 1452); XM_005618005.1, EXOSC10, Del, A_7, KQNLKLFGCFMQKTSSGLSLNSEKRSTTPTLRFF-PRSSSSPMLRNPSLRHSRKKGESA RRIVRRTWMSPLPWLISSINREPSRWSRTCIHILTSMN, (SEQIDNO:1453); NM_001197076.1, ASPM, Del, A_7, KQNLLLLWHS1L, (SEQIDNO:1454); XM_852177.4, SMARCB1, Del, A_7, KQNLTLRIMDTQPWPPA, (SEQIDNO:1455); XM_005625951.2, POLR3B, Ins, A_7, KQNQYGCETGAILFET, (SEQIDNO:1457); XM_005639977.2, MYLK4, Ins, A_7, KQNRCSESR, (SEQIDNO:1458); XM_005618072.2, ERAP2, Ins, A_7, KQNSVCIVNQQTSGKVNKIN, (SEQIDNO:1459); XM_014118543.1, RGS22, Del, A_7, KQNTGVMFLKNIGTLILMT-CLTTNWSLNISVSFLRLILQVWTLCAGQTLNS-SEESFME TESRGKQNLYILKTNTLIKN-ISLAPKVQLLNISRTR, (SEQIDNO:1460); XM_005620578.2, ZC3H18, Del, A_7, KQPFEKNRSLILKKKGLR, (SEQIDNO:1461); XM_844527.4, DMTF1, Ins, A_7, KQPNAFGE, (SEQIDNO:1462); XM_014115181.1, LOC106559028, Del, A-7, KQPPQIHLVMTWKISPSMTLIKYSAGWWPQHQ, (SEQIDNO:1463); XM_014120448.1, EML4, Ins, A_7, KQPRRRIC, (SEQIDNO:1464); XM_014120704.1, SYT6, Del, A_7, KQPSRRTLLIL-STMKPSSLIFPQRTWIKSACSSPSWIMIEWATTRS, (SEQIDNO:1465); XM_005626304.2, RUFY1, Ins, A_7, KQPSYVQHETDGRKVTALRKGTARGRGAE-PQGAAGAGRPDVRTAAAALAAA, (SEQIDNO:1466); XM_014110870.1, FSIP2, Del, A_7, KQQIQLVCQMYKLMILDKRKRK, (SEQIDNO:1467); XM_014113218.1, LOC102152874, Ins, A_7, KQQQASGPSNL, (SEQIDNO:1468); XM_533512.5, C1H9orf64, Ins, A_7, KQQRDQFHSSGLLPVGLRP, (SEQIDNO:1469); XM_014119438.1, C15H12orf29, Ins, A_7, KQQTVLLAFLSS, (SEQIDNO:1470); XM_014117106.1, LOC100685665, Del, A_7, KQRCYQLESQRQF, (SEQIDNO:1471); XM_014122749.1, ARHGAP42, Ins, A_7, KQRDAGHLNKAPRKSITTQPTKSHD-CLKPWCHIWPNSNESTRRNCGCHDEY, (SEQIDNO: 1472); XM_003434478.3, CCDC152, Ins, A_7, KQRDCSSP, (SEQIDNO:1473); XM_003434415.3, SLF1, Ins, A_7, KQRFLERYGIS, (SEQIDNO:1474); XM_014121880.C MAP4, Del, A_7, KQRHLLR-LESLNLTQSLKQLVPLRVHRNHLLGKFRFRIRRWT-SLRSPPNVGPRLTSST NLVEETSRLKVRS, (SEQIDNO:1475); XM_014121888.1, MAP4, Del, A_7, KQRHLLRLESLNLTQSLKQLVPLRVHRNHLLGKSR, (SEQIDNO:1476); XM_531825.4, C10H2orf73, Del, A_7, KQRKETQRKAK, (SEQIDNO:1477); XM_005623023.2, ROCK1, Ins, A_7, KQRKFKENTRATK, (SEQIDNO: 1478); XM_005628611.2, DNAH11, Del, A_7, KQRKIMAILHGKGLISTGSSWKVPDGTHSREPLLKPASRRSP1, (SEQIDNO:1479); XM_859339.4, CTCF, Del, A_7, KQRKPKRANCVTQRKAKMWMCLSMILRKNSRRACCQRLMQRK, (SEQIDNO:1480); XM_005635796.1, SPHKAP, Del, A_7, KQRKPLRKNGITTRKSYFMLWKTNILANIIRR, (SEQIDNO:1481); XM_005615806.2, NAA35, Del, A_7, KQRKRRKFAH, (SEQIDNO:1482); XM_005641359.2, GSPT2, Ins, A_7, KQRNLVFVLGLRYKPGRTRQG, (SEQIDNO:1483); NM_001313825.1, MEPE, Ins, A_7, KQRQYCSSKFW, (SEQIDNO:1485); XM_005633448.2, RSF1, Del, A_7, KQRRIRILK, (SEQIDNO:1486); XM_846653.4, DDX21, Del, A_7, KQRSPLKRKLFLLKQKK, (SEQIDNO:1487); XM_014110420.1, GOLIM4, Ins, A_7, KQRWRRTRSSR, (SEQIDNO:1488); XM_547403.4, BATF3, Ins, A_7, KQSCCSEKSEEADPEG, (SEQIDNO:1490); XM_860109.5, RBM39, Ins, A_7, KQSCSNGKQSTKGKCWTYEALCGLIT1, (SEQIDNO: 1491); XM_014106519.1, EPB41, Del, A_7, KQSFLKHRRKQ, (SEQIDNO:1492); XM_014109132.1, TDRD1, Del, A_7, KQSFSEINM, (SEQIDNO:1493); XM_545702.4, RGS1, Del, A_7, KQSLIFCIAKRRKYIKLLCIQMLLNKSTLTFTLENLQPRRLKHQPLRVLMKPKKLYILL WKRIPIPDFSNQIYI, (SEQIDNO:1494); XM_005623935.2, HSP90AA1, Del, A_7, KQSLKICARS, (SEQIDNO:1495); XM_014120175.1, WDR17, Del, A_7, KQSQLSLGVHITLICLQVAVPII, (SEQIDNO:1496); XM_005617376.1, C2H5orf46, Del, A_7, KQSQNSPNS, (SEQIDNO:1497); XM_533254.6, HRASLS5, Del, A_7, KQSQTQPQSLRVEGN, (SEQIDNO:1498); XM_014110795.1, CCDC173, Ins, A_7, KQSRIKSNCRI, (SEQIDNO:1499); XM_532130.5, DNAH8, Del, A_7, KQSRTGCINCPLPQT, (SEQIDNO:1500); XM_014120092.1, TEX15, Ins, A_7, KQSRTLPSNFTSRFTSENH, (SEQIDNO:1501); XM_845513.2, SSMEM1, Del, A_7, KQSRTNLLL, (SEQIDNO:1502); XM_005631781.2, MGARP, Ins, A_7, KQSRVTSTAR, (SEQIDNO:1503); XM_014122324.1, ERC2, Del, A_7, KQSSCRTSRKRRGHWPERFET, (SEQIDNO:1504); XM_532840.5, CCDC110, Ins, A_7, KQSTFFGEA TNDRNIRSTKK, (SEQIDNO:1505); XM_541240.4, SAMD3, Del, A_7, KQSTFWNPIQKRY, (SEQIDNO:1506); XM_540739.5, FNBP4, Del, A_7, KQSYEPWRKEMVVCQGLVHVLTSASQHLRMECVDLCLKGGNGRCLFELQVQNLR AGVLAKLDGRLQKMEKL, (SEQIDNO:1507); XM_014113182.1, JAK1, Ins, A_7, KQTETEKTGK, (SEQIDNO:1508); XM_014109153.1, KNDC1, Del, A_7, KQTGPQKGNKVRKVSAFPHLTWVYTFFNLNFFSSEL, (SEQIDNO:1509); XM_014107325.1, BRCA2, Ins, A_7, KQTKLQRHR, (SEQIDNO:1510); XM_005642075.2, LOC100683955, Ins, A_7, KQTKPSRAAVRPQDF, (SEQIDNO:1511); XM_014116087.1, TTLL5, Ins, A-7, KQVCKCLLGDSLKKF, (SEQIDNO:1512); XM_014113324.1, CCDC15, Del, A_7, KQVFFQTT, (SEQIDNO:1513); XM_005620894.2, DYNC1LI2, Del, A_7, KQVLLEVLVLVVCRAQPRSDKRLC, (SEQIDNO: 1514); XM_005632616.2, SETD2, Del, A_7, KQVLRRNPHNLKAPFLLQNLMKILYGLPQVKDHMI, (SEQIDNO:1515); XM_014111910.1, NKRF, Del, A_7, KQVNTQLLMRR, (SEQIDNO:1516); XM_005623862.2, RD3L, Del, A_7, KQVWIITG, (SEQIDNO:1517); XM_533327.6, DDX18, Del, A_7, KQWKLYKLERKKRNLP, (SEQIDNO:1518); XM_014109265.1, NDUFAF6, Del, A_7, KQWTTYTVITHPSSLWPWSCGR1, (SEQIDNO:1519); XM_005617866.2, HP1BP3, Del, A_7, KQYLPGLPFLPAS, (SEQIDNO:1520); XM_014111056.1, DNAH7, Del, A_7, KQYMIINLSLRE, (SEQIDNO:1521); XM_005618261.2, ZNF518B, Ins, A_7, KQYVPTQTGFSFSLLKRSFSSISSKKQYFPQSWSCIKSLSI, (SEQIDNO:1522); XM_014109202.1, CCNE2, Del, A_7, KRADMFTTNILKFCILTWSHR, (SEQIDNO:1523); XM_005637210.2, C1S, Del, A_7, KRAGNFVTVEIQSLVPKKSLPILFGSLRKQYMYSKM, (SEQIDNO:1524); XM_014118152.1, CASP8AP2, Del, A_7, KRALCIC1HLLKNTAPMAFGHVPIIRLVRVSQMRIVEEGEKILDIANIAEERIEYGKT, (SEQIDNO:1525); XM_005634010.2, SLITRK1, Del, A_7, KRALQVCSVSPPRLPSFTIYFCMVIPSLDFSLMSLLTFIMRLVCTWKTMACMKSFLGL FWGCSW, (SEQIDNO:1526); XM_545798.5, NIPA1, Del, A_7, KRASCAPSGEVPPI, (SEQIDNO:1527); XM_014110232.1, GOLGB1, Ins, A_7, KRCGNPPTNYPGEGSASDRNQ1, (SEQIDNO:1528); XM_014120722.1, SYCP1, Del, A_7, KRCQKKIFCKRLRKQKQ, (SEQIDNO:1529); XM_846379.3, ANKRD13A, Del, A_7, KRDIKRTGTHWNLCWELWNTSLEPKGTSPQNVPLPTTPQPSRLTSILMKSLI, (SEQIDNO:1530); XM_005624542.1, MED24, Del, A_7, KRDIVKTSRIMSVSSPWMTCSPQS, (SEQIDNO:1531); XM_544163.4, CPNE3, Del, A_7, KRDKRRKATRIQVLSV, (SEQIDNO:1532); XM_014122577.1, CEP295, Del, A_7, KRDLPKLQVCHHHLQVFLRTLI, (SEQIDNO:1533); XM_539103.4, FBXO43, Del, A_7, KRDLSFLGRNMIKPQNSVKPLKSVEKNFCCAEGWTYLSLF, (SEQIDNO:1534); XM_843366.4, CHD1, Del, A_7, KRDRLIHLRRKMMKKIMIMIKEVLVAKQLSMLAIKKMKK, (SEQIDNO:1535); XM_005617803.2, STPG1, Del, A_7, KRDSTVKPRDFIIKRMVSQVPGSMTSFTNLQCSTMSHCLRKGHALFPLWPLSLAASR ETTSLPEPGLCPKPREDFSLSLKQDLPQGITISMNPL, (SEQIDNO:1536); XM_014118080.1, DST, Del, A_7, KRDVIPSVPLCPLLPRTQLEMRYLISMLLESRRICLLRRDCYCGHSRQQRVTLEYGVK ISLPAGEMENYLMPSFINTGRT, (SEQIDNO:1537); XM_005640326.2, ZAK, Ins, A_7, KREINHSKQLPQKFC, (SEQIDNO:1539); XM_542038.5, RAD23A, Ins, A_7, KRELGCQLPPESEL, (SEQIDNO: 1541); XM_005636026.2, OAS2, Ins, A_7, KREMPYHQGNP, (SEQIDNO:1542); XM_005621959.2, LOC490172, Del, A_7, KREMSFVNRTCKHQQIVAQIYLRKFSVL, (SEQIDNO:1543); XM_014114846.1, ZNF644, Del, A_7, KRESEKWM, (SEQIDNO:1544); XM_005619490.2, LEPR, Ins, A_7, KREWCVFD, (SEQIDNO:1545); XM_014110067.1, STPG2, Del, A_7, KREYQGLENMTLKANFGRLKVYQV, (SEQIDNO: 1546); XM_005615576.2, DSE, Del, A_7, KRFDRKLRSWHRKNCP, (SEQIDNO:1547); XM_005632455.2, GNL3, Del, A_7, KRFESTIEN, (SEQIDNO:1548); XM_005640932.2, KCTD3, Ins, A_7, KRFFRSRVQFV, (SEQIDNO:1549); XM_014107556.1, FDFT1, Del, A_7, KRFHCYTTFTLTFMNQTGGIWRARRRIDKC, (SEQIDNO:1550); XM_547475.5, BLZF1, Del, A_7, KRFHQWLNSAAPQQKKWLKRFYAFWIQLPVQKAHLIIHFLSLHQLPYLRQRKILDDF IPILDMKI, (SEQIDNO:1551); XM_014109094.1, KIF20B, Del, A_7, KRFPHVHHLRKHTLYGVRHPQLVQTWPLR, (SEQIDNO:1552); XM_014118910.1, AVL9, Del, A_7, KRFSFIFLQ, (SEQIDNO:1553); XM_014121497.1, LOC476151, Del, A_7, KRFTNWRNKG- PLKFRRKGMGTLPYCQWWL-LAHCPRGQKRQWVTLWDR, (SEQIDNO:1554); XM_545270.2, LOC488146, Del, A_7, KRGG-GRGQKNVLDSLIRLCLVSRGQKKIAESANFLIS-LKKM, (SEQIDNO:1555); XM_014108010.1, MYO18B, Del, A_7, KRGGLQGLLVAPRPALRTQPQRPR-SPGLRVLGTQAWCY, (SEQIDNO:1556); XM_014117407.1, LOC102155766, Ins, A_7, KRGGTIFQTHVFRIPMDIFREFFAAT, (SEQIDNO:1557); XM_005636809.2, SLC4A8, Del, A_7, KRGITSFPL-FAPLLRLARSSLIHTQWIKMVKLYLLSLFLLQVLK, (SEQIDNO:1558); XM_014120175.1, WDR17, Del, A_7, KRGKLYMLMEVYQFFNQVIKVRSMF, (SEQIDNO:1559); XM_532888.5, ATAD2B, Del, A_7, KRGKTRCLI-FIDLQQEEVISGERSMPFIVVTQLLLMKNALKEG-NQRAWQEQEIDVCL, (SEQIDNO:1560); XM_005617350.2, RBM27, Ins, A_7, KRGWQVER1, (SEQIDNO:1561); XM_014113761.1, DAB1, Del, A_7, KRHKRISSVNKLCIRQFWKRMLKILYT-STLCLRLDTSQSVIPKQKKTFIRFPPAKRRK VFMMCQKVNL, (SEQIDNO:1562); XM_005628697.2, PDE1C, Del, A_7, KRHLEKLRIKLTEHAQTKVTTL-VERIPNLRSPQEKNNRMVT, (SEQIDNO:1563); XM_005615829.2, CEP78, Del, A_7, KRHLKK-KNQNQSRTP, (SEQIDNO:1564); NM_001286231.1, TAF9, Del, A_7, KRHQLLREE, (SEQIDNO:1565); XM_003639075.3, NAE1, Del, A_7, KRIIAILHGL, (SEQIDNO:1567); XM_005620886.2, ADAMTS18, Ins, A_7, KRIPHLTVTSAAGPGA, (SEQIDNO:1568); NM_001005869.1, HTR2A, Del, A_7, KRIQRKM-PRAQIMTTAWLL, (SEQIDNO:1569); XM_014111472.1, CYLC1, Del, A_7, KRIREFQKKTKINLQ, (SEQIDNO:1570); XM_005617440.2, SREK1IP1, Del, A_7, KRIS-QKEGNIIKRKKKRREKRRSIHPLLILLRSPKS, (SEQIDNO:1571); XM_005621999.2, SSX2IP, Del, A_7, KRISRRKDEALQKQPFA, (SEQIDNO:1572); XM_860876.4, SPAG9, Del, A_7, KRIYRPEWNL, (SEQIDNO:1573); XM_005641136.2, BMX, Del, A_7, KRKCRQAITKRGFLF, (SEQIDNO:1575); XM_005621851.2, RNPC3, Del, A_7, KRKDLMTLWK-MIKKRKNLVV, (SEQIDNO:1576); XM_005627838.2, UBR5, Del, A_7, KRKEKNRMWCQKKLKVQNQGHLL-MILLHN, (SEQIDNO:1577); XM_014115025.1, LOC100683727, Del, A_7, KRKHGRGWSLKSALLET-ALQENHLNRKDSLGQWAYVSKRPM, (SEQIDNO:1578); XM_014110866.1, NR4A2, Ins, A_7, KRKIRVFSK, (SEQIDNO:1579); XM_005627752.1, LOC100856021, Del, A_7, KRKKAKPKNCLKKSLSKGSNCINKT-GEKQNYMLTGERNNKKKIFFLQLLLLWIQTA LIPIS-SYLRIENKFL, (SEQIDNO:1580); XM_005631271.2, LRP4, Del, A_7, KRKKKKKRLKRIPTKPERRLSPSAL-GKVELEGSGLRLAKRILLLQSCQNCVHSSALR MEASPAALSVLVVGATSRVR, (SEQIDNO:1581); XM_014115156.1, RASA12, Del, A_7, KRKKKTRIIM, (SEQIDNO:1582); XM_005638100.1, CNBD1, Del, A_7, KRKKLKNLFVWVNLRKRSPLVRLVFFFKFLSHVL, (SEQIDNO:1583); XM_014120446.1, EML4, Del, A_7, KRKKNHKDRGKKKRNLILM-IKVHKFEHHLLPSPLHSLSKYTDKLKKARILLPPKA, (SEQIDNO:1584); XM_847054.5, TRIM24, Del, A_7, KRKLKALLN, (SEQIDNO:1586); XM_014114906.1, LRRC7, Del, A_7, KRKMTKMLGKLRITPAKPPGK-GASVGLLSNLPDCLAIAAHHGPGVISRSKICPSPRM THSWHGVV, (SEQIDNO:1587); XM_014114904.1, LRRC7, Del, A_7, KRKMTKMLGKLRLK, (SEQIDNO:1588); XM_533405.4, FAM210A, Del, A_7, KRKN-LILYKTNLLIYINDLRKHLDNMGKF, (SEQIDNO:1589); XM_536590.4, GUCY1A2, Del, A_7, KRKQWIFCILF-SLVM, (SEQIDNO:1590); NM_001003222.1, CNGA1, Del, A_7, KRKRKKKRRANQEIKM-KIKRTQRRKRRKKRKKRRKIKRRKAKIRKKRRRKR-SWLLI LQETC-TITGCFASLYLLCTTGLWLLQEHVLMNFSLIT, (SEQIDNO:1591); XM_005632477.1, LOC484748, Del, A_7, KRKRKTKTKRKKRQKKRQRKRKRRRKKSLYFQLHPL, (SEQIDNO:1592); XM_005627803.2, ANGPT1, Del, A_7, KRKRNHLETVQMYIKLVLIKVESTLFIL-IICQNPKRYFAIWILLGEVGL, (SEQIDNO:1593); NM_001005754.2, ANGPT1, Del, A_7, KRKRNHLETVQMYIKLVLIKVESTLFIL-IICQNPKRYFAIWMSMGEVGL, (SEQIDNO:1594); NM_001003057.1, TCOF1, Del, A_7, KRKRRRQKRPQPKTLTHYSRRKRRKRRRQQSKLS, (SEQIDNO:1595); XM_005636842.2, FAM186A, Del, A_7, KRKSHLCHDCIFRSQLVQSLKLAPYSHLRAW-THY, (SEQIDNO:1596); XM_014106893.1, MAST4, Del, A_7, KRKSRGKSQSPFLPVPCPS, (SEQIDNO:1597); XM_014116492.1, NF1, Del, A_7, KRKT-KNQWLASVSLRTASVQWEVPCSSDLSIL-PLSHRTKQGF, (SEQIDNO:1598); XM_014115197.1, GORAB, Del, A_7, KRKWNCKKNLIGKSSNKSNG, (SEQIDNO:1600); XM_005618382.2, PDE8A, Del, A_7, KRLICSIL, (SEQIDNO:1601); XM_014120337.1, BIRC6, Del, A_7, KRLIFLLLDTW, (SEQIDNO:1602); XM_005625193.2, GTF3C4, Del, A_7, KRLKAVEP-PIFGVSNFSS, (SEQIDNO:1603); XM_014108224.1, PCDH15, Del, A_7, KRLKILQRFWIAMFR-SKSLVPRWWWSPLVLAGMGMPF1, (SEQIDNO:1604); XM_848166.4, FAM135A, Del, A_7, KRLKKPLKK, (SEQIDNO:1605); XM_003432210.3, TAF1B, Del, A_7, KRLKLANS, (SEQIDNO:1607); XM_014108373.1, CECR2, Del, A_7, KRLKTSLSWMMISLPCIKF, (SEQIDNO:1608); XM_014107327.1, PARP4, Ins, A_7, KRLLLDRSTTR1, (SEQIDNO:1609); XM_014108433.1, ATF7, Del, A_7, KRLLLGPLTCLC11HQTSKSKKKSQWR, (SEQIDNO:1610); XM_014111409.1, SMARCA1, Del, A_7, KRLMELNLLHQKRLKKKKNFSHKDLQTGLSEILT-SLLKLMRSMEEMTLII, (SEQIDNO:1611); XM_014113657.1, SOGA3, Del, A_7, KRLNRLPQRRTTKTSSAICSS, (SEQIDNO:1612); XM_014121623.1, TRNT1, Ins, A_7, KRLPNGER, (SEQIDNO:1613); XM_005634369.2, EFHB, Del, A_7, KRLQRYYVTLVLSFLMKNLKMYGILHQKNT-TEEKFVLKPSEMFWMSYNMQTESSV KQAC, (SEQIDNO:1614); XM_014112884.1, MICU1, Del, A_7, KRLQVFVLSLIRKRKRRNVLDSETEK, (SEQIDNO:1615); XM_005640290.2, PPIG, Del, A_7, KRL-REIKVHSQK, (SEQIDNO:1616); XM_005620795.2, SLC7A6, Del, A_7, KRLRGKLT, (SEQIDNO:1617); XM_538880.5, FKBP5, Del, A_7, KRLRSTMSETAG-YMPTCLRSLQNRMQRKRPVKPWARRL, (SEQIDNO:1618); XM_546165.5, DNAJC9, Del, A_7, KRLSRKKRN, (SEQIDNO:1619); XM_532408.5, AFM, Ins, A_7, KRLWGTYEIWPASLRIHKCCYT, (SEQIDNO:1620); XM_005618341.2, AGBL1, Del, A_7, KRMCSFMAVAS-RRLCGKQSLLWAHQLSQKTSPTGLFPKSLIS, (SEQIDNO:1622); XM_014110764.1, KCNH7, Del, A_7, KRMHPLLLQIKPLLHPRLKIEHTM, (SEQIDNO:1623); XM_014111664.1, DACH2, Del, A_7, KRNCEWSSIER-EKLEKTLKDNLQLSFKAELPCKNV, (SEQIDNO:1626); XM_535698.4, LARP7, Del, A_7, KRNGHELNKCWQILLSKWTSGLEMQIYTKIDFFESK, (SEQIDNO:1628); XM_014107297.1, PSMA7, Del, A_7, KRNKRKHH, (SEQIDNO:1629); XM_014116764.1, ATAD5, Del, A_7, KRNKRKRWKF, (SEQIDNO:1630); XM_534564.5, PBK, Del, A_7, KRNLHYVQLHV, (SEQIDNO:1631); XM_005622441.2, SWT1, Del, A_7, KRNLRGKAPLHHPTLT, (SEQIDNO:1632); XM_014122663.1, UPF2, Del, A_7, KRNMKRKRKRSKKSRQNVSKKKKLPS, (SEQIDNO:1633); XM_005619653.2, C5H11orf63, Del, A_7, KRNMRNKLRSIT, (SEQIDNO:1634); XM_014109424.1, MGA, Del, A_7, KRNRDNRPHHCPHHFSSRAHVSLILRTVV, (SEQIDNO:1636); XM_005638550.2, LRRC49, Del, A_7, KRNSARCIWRT1, (SEQIDNO:1637); XM_014122790.1, NUCB2, Del, A_7, KRNSWSRIAGRQWISNSSSQRKN, (SEQIDNO:1638); XM_005636681.2, PTHLH, Del, A_7, KRNVELGLPG, (SEQIDNO:1639); XM_005615345.2, VPS4B, Del, A_7, KRNYRINFKVP1L, (SEQIDNO:1640); XM_005626595.2, FAM13B, Del, A_7, KRNYVKHYGNLKKHFINRMEGMPRKRIVFQCLKSIGSTRKLKPNLGFLKFLSANKIL QNPY, (SEQIDNO: 1641); XM_014109405.1, LPCAT2, Ins, A_7, KRPHPFCW, (SEQIDNO:1642); XM_014118865.1, UTRN, Del, A_7, KRPLMKSLRIRDLHYIHLQKKQRLWRKLFLQM, (SEQIDNO:1643); XM_014121542.1, LOC106560070, Del, A_7, KRPLRPFSYS, (SEQIDNO:1644); XM_536179.5, CHD2, Ins, A_7, KRPNNQNIGGSG, (SEQIDNO:1645); XM_005620334.1, DOCK7, Del, A_7, KRPRSWHLQHTRILQTPKCFRWYSRG1, (SEQIDNO:1646); XM_005629420.2, LOC102153096, Del, A_7, KRPSPLLDVSSNFISFSLWELLNVCSWPSWPLIGTLLSAVPCTTLIS, (SEQIDNO:1647); XM_005616743.2, LOC484590, Del, A_7, KRQKIGNQDGKTRNY, (SEQIDNO:1648); XM_005623593.2, MED6, Del, A_7, KRQNLYQKR, (SEQIDNO:1649); XM_005632477.1, LOC484748, Del, A_7, KRQRKRKRRRKKSLYFQLHPL, (SEQIDNO:1650); XM_014108798.1, SORBS1, Del, A_7, KRQRMTAGGWLRALRT, (SEQIDNO:1651); XM_005634496.2, CEP70, Del, A_7, KRQRTQRNQMNPTEITSSRP, (SEQIDNO:1652); XM_014106506.1, EPB41, Del, A_7, KRQRVVKNMLHQESHLESKMDHFLTLILPW, (SEQIDNO:1653); XM_014106519.1, EPB41, Del, A_7, KRQRVVKNMLHQESHLESKMDHFLTLMWVTSSPPSFEVSSLPW, (SEQIDNO:1654); XM_005626399.1, HSPA4, Ins, A_7, KRRAEWTSGRTRRQPRPPGC, (SEQIDNO:1655); XM_014112377.1, LRRK1, Ins, A_7, KRRDKNHLPVGNEGLLRDGFYHRPCQFPDRSVVSRPDSHRK, (SEQIDNO:1656); XM_535884.5, PAK1IP1, Del, A_7, KRREKRRKH, (SEQIDNO:1657); XM_005617440.2, SREK1IP1, Del, A_7, KRREKRRSIHPLLILLRSPKS, (SEQIDNO:1658); XM_005622787.2, ATP8B2, Ins, A_7, KRRGAVLQGSVPGRGGPGHRSQELRFCIPLSHPQNHHCPRDGHSRHLSAAGHPGLQ, (SEQIDNO:1659); XM_541861.5, PARP3, Del, A_7, KRRGGRVQRRRTASAPLPRPSELHPQRST, (SEQIDNO: 1660); XM_005638175.2, FGF7, Del, A_7, KRRKNKKQPTFFLWQ, (SEQIDNO:1661); XM_005624373.2, NMT1, Del, A_7, KRRKRKAMRQIQPRISL, (SEQIDNO:1662); XM_014108062.1, DENR, Del, A_7, KRRLYHKKLR, (SEQIDNO:1663); XM_005630156.2, NT5C1B, Del, A_7, KRRMRLDRRTQKTA, (SEQIDNO:1664); XM_014115182.1, SUCO, Del, A_7, KRRNAASTKLKKLKP, (SEQIDNO:1665); XM_014121595.1, LOC106560076, Del, A_7, KRRNMGKKCP, (SEQIDNO:1666); XM_014119891.1, UBN2, Del, A_7, KRRNVTKILFLWLP, (SEQIDNO:1667); XM_014115188.1, PRRC2C, Ins, A_7, KRRPQIRP, (SEQIDNO:1668); XM_014117357.1, FAM227A, Del, A_7, KRRQTTCSSNLQASLRNPLTRNVEEVMRGRLRFFQGLGSSCRRPGALIFLPERTPRSQ NQRRN, (SEQIDNO:1669); XM_005636081.1, SFSWAP, Del, A_7, KRRRGAHGHGPSPRPGPSRRPQASKPHVGTRPTQPASLPWRVGAPVRSAPGEFLRKK TARSPQQLSPLCRAK, (SEQIDNO:1670); XM_847542.4, CPLX4, Del, A_7, KRRRGHASEFISEKNTDSQRVKWTRTKSRWPETMWTCPKISGKW, (SEQIDNO:1671); XM_005641516.2, ATRX, Del, A_7, KRRRGILPCCQRTPYLQNFFKYIKNT1, (SEQIDNO:1672); XM_535608.5, SDAD1, Del, A_7, KRRRNQRCLTFQLFI, (SEQIDNO:1673); XM_537657.5, CWC25, Del, A_7, KRRRRKRRRKRKRSTRNISTEAQVVMVAVARMSAVGGDLKRSWQILPLCCPKPLDM AYRSGTPVIAREYRV1, (SEQIDNO:1674); XM_014113549.1, CHD3, Del, A_7, KRRRRQSGGKKGREMGDKR, (SEQIDNO:1675); XM_014113564.1, CHD3, Del, A_7, KRRRRQSGGKKGREMGDKSR, (SEQIDNO:1676); XM_005640523.2, NIF3L1, Del, A_7, KRRTSFSPTIHLFFDP, (SEQIDNO:1677); XM_003434147.2, GPR160, Del, A_7, KRSCPSSLSVFSALGYHLYYFK, (SEQIDNO:1678); XM_005622874.2, GALNT1, Del, A_7, KRSEDFLLGMF, (SEQIDNO:1679); XM_014116352.1, EFCAB13, Del, A_7, KRSGERKIYKYNCILKELSLPLPQ, (SEQIDNO:1680); XM_005622350.2, TMEM206, Ins, A_7, KRSGSKPHKL, (SEQIDNO:1681); XM_005629009.2, RNF11, Del, A_7, KRSGSVLSV, (SEQIDNO:1682); XM_014113160.1, CDH18, Del, A_7, KRSHILSP, (SEQIDNO:1683); XM_005639570.2, PARP14, Ins, A_7, KRSISGFSPTVSGV, (SEQIDNO: 1684); XM_014110716.1, SCN1A, Del, A_7, KRSLEVKTSS, (SEQIDNO:1685); NM_001197076.1, ASPM, Del, A_7, KRSLQSSHLTEGWWQRRSCRRCTGLRFSSRPLTECTEHMLHFRPGNMPPF, (SEQIDNO:1687); XM_014119381.1, ARHGAP10, Del, A_7, KRSLTKRQKRTIV, (SEQIDNO:1688); XM_005640039.2, HIVEP1, Del, A_7, KRSPIRGEGPCLSVKPVETGIENWRILKTIRNFTAQSYTDQKQR, (SEQIDNO:1689); XM_537556.5, DYNC1H1, Del, A_7, KRSQNLKWGSFTCSKILKFQRSACQFIPLLQMLQNNVMNVEKSQKLQTLEIRLKTQL FSISYNQELTVGYEKFKK, (SEQIDNO:1690); XM_005633942.2, DIAPH3, Ins, A_7, KRSRGKGKTCPNSQRIGRERKT, (SEQIDNO:1691); XM_005636081.1, SFSWAP, Del, A_7, KRSRGSALMMMMMKKMEVTCTRLFLLPRSVIAWRS, (SEQIDNO:1692); XM_541885.4, BSN, Del, A_7, KRSRIPWRLDTRPSCPRNPCHSS, (SEQIDNO:1693); XM_547161.5, MEFV, Del, A_7, KRSSCSTGNQSL, (SEQIDNO:1694); XM_005631005.2, ABCA13, Ins, A_7, KRSSLQLF11, (SEQIDNO:1695); XM_538557.5, FEM1C, Ins, A_7, KRSTWGLKILEKGNEHEVQR, (SEQIDNO:1696); XM_005637237.2, CHD4, Del, A_7, KRSVCSYAGSWGTALGRGRSLWRRRKRWLFAQTVRAATIPLARRRRRSLDLRKKR RANPSGRK RKKRMTTTMIQRSLNHLLSS, (SEQIDNO:1697); XM_005637236.2, CHD4, Del, A_7, KRSWGTALGRGRSLWRRRKRWLFAQTVRAATIPLARRRRRSLDLRKKRRANPSGR KRKKRMTTTMIQRSLNHLLSS, (SEQIDNO:1698); XM_003638844.3, KIAA0355, Del, A_7, KRTAVAAYLA, (SEQIDNO:1699); XM_003432274.3, LOC100683958, Ins, A_7, KRTELPRPHREIPHIQGYC1HLGQPAAEI, (SEQIDNO:

1700); XM_014116869.1, CAMSAP1, Del, A_7, KRTGLCLSQHPSPCIMLPAVTWTLALVTASAW-PAPSARIVWPLMSLT, (SEQIDNO:1701); XM_014118968.1, ZNF800, Del, A_7, KRTHRQHRKIKLNKTRKAL-NQLVRLLQVASKKPGNQNFQLALTL-SNFTVNFVNVSL LPNRT, (SEQIDNO:1702); XM_014117291.1, GOLM1, Del, A_7, KRTKASSSEPPVSLSPGHRKQTCLRQRYHK, (SEQIDNO:1703); XM_005623645.2, FAM161B, Del, A-7, KRTKQMRVLSG, (SEQIDNO:1704); XM_014115695.1, PLEKHD1, Del, A_7, KRTLKPINTSIYILRVSSP-WEAAWWRPRKNPACPMP, (SEQIDNO:1705); XM_005616957.2, LOC480753, Del, A_7, KRTMVLILLKVLHKSKQLMTI, (SEQIDNO:1706); XM_014118915.1, CTTNBP2, Ins, A_7, KRTSRKTKPTGLPTTVSRLPCV, (SEQIDNO:1707); XM_536010.5, TMEFF2, Del, A_7, KRTTVYC-TLFPAPCDFSMS, (SEQIDNO:1709); XM_014120322.1, KIDINS220, Del, A_7, KRVAYHLLSSSFLSLAALL-RELPSWLSLELTQNI, (SEQIDNO:1710); XM_548229.6, EPX, Del, A_7, KRVFSPRDSARPCARFPCLELCVTI-RASPPFRGTSSGPTFSHGAL, (SEQIDNO:1711); XM_005616337.2, IZUMO1, Del, A_7, KRVFVPTNVVRCCR1, (SEQIDNO:1712); XM_014120373.1, ALMS1, Del, A_7, KRVGHYQKL-LISPHVERSTVFSTNRSF, (SEQIDNO:1713); XM_005640584.2, ZDBF2, Del, A_7, KRVIHIVVLE, (SEQIDNO:1714); XM_534457.5, ATP9A, Ins, A_7, KRVLF-PADGSAGRGDRLEAAAPRGLHAEAPHCCRSPSDSII-CLCRRAKYRHSQLCGN FYQRGQRPSDQREFEH, (SEQIDNO:1715); XM_536972.4, RSL1D1, Del, A_7, KRVLVPTDPVEKRERPVQVWRPRRLQR-PRLQVTAQRRSQESKKRQRKKETLHWGK KTQDRRPKSQEPGSLLLLINLQKKLPTPPNSGPK-SAKYPSQP, (SEQIDNO:1716); XM_539460.4, MACC1, Del, A_7, KRVTTYLNISKGTQ, (SEQIDNO:1717); XM_005620292.2, ACAD8, Del, A_7, KRWGGTHSQPAR, (SEQIDNO:1718); XM_014106605.1, GOLGA4, Del, A_7, KRWKKLSRKQKRCKKR, (SEQIDNO:1720); XM_539598.4, CLSPN, Del, A_7, KRWKKSGG, (SEQIDNO:1721); XM_014108060.1, STX2, Ins, A_7, KRYERHRLRRAC, (SEQIDNO:1723); XM_014109449.1, ZNF106, Ins, A_7, KRYRSVLRPSSA, (SEQIDNO:1724); XM_005641356.2, SHROOM4, Del, A_7, KRYSLLKA-LAENSLS, (SEQIDNO:1725); XM_014113138.1, C4H5orf42, Del, A_7, KRYVIRKKILKE-KIMKSYYKMRF1, (SEQIDNO:1726); XM_003433297.3, ATP8A2, Del, A_7, KRYWRRYKSWRRSPE, (SEQIDNO:1727); XM_005623717.2, CEP128, Ins, A_7, KSAAPAD-AMQTAAAEEYDGKQGI, (SEQIDNO:1728); XM_005620663.2, C5H16orf46, Ins, A_7, KSANKGI-CLVQGRLGHH, (SEQIDNO:1730); XM_005629927.2, KLKB1, Del, A_7, KSAPIAFTANFSHMPLKHFTT, (SEQIDNO:1732); NM_001003040.2, RPI, Del, A_7, KSAS-TRAETHSLAGSRWWSTRVPSRHLMLCSITYQGR-CLYLSG, (SEQIDNO:1733); XM_005625479.2, CDK2, Del, A_7, KSAWTLRRRVYPVLLYERSPCLRSLT-TRTLSSYWMSSTQKTNSTWFLNFCTRI, (SEQIDNO:1734); XM_005641542.2, ZNF711, Ins, A_7, KSAY-YEAPQGGSYV, (SEQIDNO:1735); XM_542243.5, ANKRD49, Ins, A_7, KSAYYSAEATV, (SEQIDNO:1736); XM_005618061.2, GIN1, Del, A_7, KSCFMLEKTEN-KIVW, (SEQIDNO:1737); XM_005638791.2, LTN1, Ins, A_7, KSCGTVFISETDRLAK, (SEQIDNO:1738); XM_005639666.2, DNAH5, Del, A_7, KSCRKPISLFWSY, (SEQIDNO:1739); NM_001024633.1, HTR2B, Del, A_7, KSCSMLPIIF, (SEQIDNO:1740); XM_532888.5, ATAD2B, Ins, A_7, KSDGGPGGKYFKRVA-VVSQGCNQEAGHR, (SEQIDNO:1741); XM_546022.5, FAM81B, Del, A_7, KSDQQKIKPGNQAS, (SEQIDNO:1742); XM_014115916.1, ATG14, Ins, A_7, KSEALYSSTAASREKGEDSEAQSQTW, (SEQIDNO:1743); XM_014111056.1, DNAH7, Del, A_7, KSEQR-WRISSSTFLSFK, (SEQIDNO:1745); XM_540029.5, TRAPPC11, Del, A_7, KSEVQSCLLSMLHGCLNNSR-PLEIYLMKLLS, (SEQIDNO:1746); XM_014119220.1, LOC482280, Ins, A_7, KSEWGETL, (SEQIDNO:1747); XM_014106804.1, TOPAZ1, Ins, A_7, KSFKGFEKNKP, (SEQIDNO:1748); XM_014109263.1, ST18, Del, A_7, KSFLERPPYQVLNPSSMQEISKKN, (SEQIDNO:1749); XM_014119514.1, ZMYM4, Del, A_7, KSFRRGKLLIR-GKGLLSFSAPRCASLDIQFHLPAHRLLP-PRKLVQAAQKIF, (SEQIDNO:1750); XM_014119662.1, ZMYM1, Del, A_7, KSFRRGKLPIRGKGLLSFSAPR-CASMSTFHLPIHQLFPRELVQTAQKTS, (SEQIDNO:1751); XM_005638519.2, SPG21, Del, A_7, KSF-SETFHLAQWTL, (SEQIDNO:1752); XM_857524.4, TAOK3, Del, A_7, KSFSKRHEMDP, (SEQIDNO:1753); XM_005631802.2, SCLT1, Ins, A_7, KSGCSSGEAKRRR-CRENERNCLSACARCCHDNQEGSCKHKKTV, (SEQIDNO:1754); XM_005620231.2, INAD1, Del, A_7, KSGKDMQTFLENCTLLSLKRIRMDLDSALMKTDHA, (SEQIDNO:1755); XM_005616873.2, CD3EAP, Del, A_7, KSGKSYSRILC, (SEQIDNO:1756); XM_005638256.1, CASC5, Del, A_7, KSGKVRLGVVILH-KIRRFLITMLKGI, (SEQIDNO:1757); XM_014110145.1, SLC9Cl, Del, A_7, KSGNIYLMRIGTTRCN, (SEQIDNO:1758); XM_535303.4, RBL2, Del, A_7, KSGPVLNSP, (SEQIDNO:1759); XM_014110756.1, BAZ2B, Del, A_7, KSGQIFSK, (SEQIDNO:1760); XM_014119283.1, ANKS1B, Del, A_7, KSGRLNLLTF, (SEQIDNO:1761); XM_005639728.2, MFN1, Del, A_7, KSGRLQKRWQTRFHVQ, (SEQIDNO:1762); XM_014117699.1, RAPGEF6, Ins, A_7, KSGRYENEWS-SPVIEYCLCCKGQVETGGAAKGFPGVPSAFQP, (SEQIDNO:1763); XM_540380.5, SLC26A3, Del, A_7, KSGSCRRKACCK, (SEQIDNO:1764); XM_014120481.1, SELV, Ins, A_7, KSGTAISKLSTL, (SEQIDNO:1765); XM_003639255.2, LOC100856208, Del, A_7, KSHCLRQPMLRPRKPRPAVPEIPAHLRHSPRPTSWA, (SEQIDNO:1766); XM_014108894.1, CCDC125, Ins, A_7, KSHERQFCIKVLGEIFRIPCTA, (SEQIDNO:1767); XM_014114271.1, ZNF789, Del, A_7, KSH-ISVMTVENFSARWHILLNIRGSIPKKNPINVV-SAKKHLVRIQPLFDIS, (SEQIDNO:1768); NM_001003018.2, ASB17, Ins, A_7, KSHQHCDNNI-ALPFKSENNG, (SEQIDNO:1770); NM_001003212.1, F8, Del, A_7, KSHRRTQLLKGKTPFCPWALVKIMIQQQQ, (SEQIDNO:1771); XM_014110685.1, LOC102155713, Del, A_7, KSHSLRPRRDKGLPCRHNITREPPLTHPELN-TEEQGRKTSAFVSAVLPTPTQWSHQH, (SEQIDNO:1772); XM_003639317.1, LOC100856706, Del, A_7, KSHSYQRC, (SEQIDNO:1773); XM_005627613.2, RARS2, Del, A_7, KSIFSKCSKCFRSWDMTQK-GASTCPLEWCRE, (SEQIDNO:1774); XM_005628720.1, KIAA0895, Del, A_7, KSIIHKNSLPPPTPKDVEN-PANLLVLLVVKIFAR, (SEQIDNO:1775); XM_843679.5, SON, Del, A_7, KSIKDSQKNLSQR, (SEQIDNO:1776); XM_863061.4, PNISR, Del, A_7, KSIKRKRNKEG-VDQEVLVVVVPVAIAELVVLVVLSLALHIV-LAQVVVALLLDLLLLK GKKDI-VGVDLQQLKLDGVEVEVTHAE, (SEQIDNO:1777); XM_014118132.1, ZNF484, Del, A_7, KSILERN- TLNVLNVEKPSQGNQ1, (SEQIDNO:1778); XM_005634064.2, CCDC168, Del, A_7, KSILLIKAVILDTH, (SEQIDNO:1779); XM_541074.4, SERPINB3, Del, A_7, KSINFFKNTWITLRNFT, (SEQIDNO:1780); XM_005639981.2, RIPK1, Del, A_7, KSIQTQPKIQL, (SEQIDNO:1781); XM_535027.5, FAM204A, Del, A_7, KSISRALKRA, (SEQIDNO:1782); XM_005642460.1, LOC100686962, Del, A_7, KSISVITQGDFISALLSWVLGDLVLAGITGK, (SEQIDNO:1783); XM_005639173.2, NAP1L5, Del, A_7, KSITTSISPYLPRSKSSPVRWRGVHGP, (SEQIDNO:1784); NM_001287155.1, SLC39A6, Del, A_7, KSNTMTMTITPTMITTLTVIMLLPIKIIGKLFVQTMNLIVWVRIPETARGKDLTDQSMP MVKGMF, (SEQIDNO:1785); XM_005620937.2, LOC102154551, Del, A_7, KSKAKQRMKNQE, (SEQIDNO:1786); XM_014116115.1, SPATA7, Ins, A_7, KSKCLRQLNRPRDLCERH, (SEQIDNO:1787); XM_014108938.1, PCGF6, Del, A_7, KSKCMISIKKEV, (SEQIDNO:1788); XM_014119970.1, GIMAP4, Del, A_7, KSKCYKNFTEQS, (SEQIDNO:1789); XM_535949.5, KLHL41, Del, A_7, KSKFSKTPSQANSQNLAKMQRRLGPVR, (SEQIDNO:1790); XM_005630608.2, CTSS, Ins, A_7, KSKICDASQSGTLNGNAFI, (SEQIDNO:1791); XM_005635396.2, CKAP2, Del, A_7, KSKMTKQSI, (SEQIDNO:1792); XM_536278.5, NCAPG, Del, A-7, KSKPFKVKMQK, (SEQIDNO:1793); XM_014118171.1, USP45, Del, A_7, KSKRMEEKV, (SEQIDNO:1794); XM_014113144.1, SPEF2, Del, A_7, KSKSALKKMLLHESKGRKDGGDY, (SEQIDNO:1795); XM_014115252.1, EFCAB2, Del, A_7, KSKTLLKCLTTRRIIQWM, (SEQIDNO:1796); XM_005641935.2, MTM1, Del, A_7, KSKTSFILMWKSLTGCPVWSLPIG, (SEQIDNO:1797); NM_001313774.1, CLGN, Del, A_7, KSKVMVKLLKKKRKLNLRKRVKKKLKS, (SEQIDNO:1798); XM_005627636.2, MDN1, Ins, A_7, KSLAGLGIGPQS, (SEQIDNO:1799); XM_014117631.1, CCDC112, Del, A_7, KSLFRTGKPKSSKRRRKFSS, (SEQIDNO:1800); XM_014110411.1, B3GALNT1, Del, A_7, KSLGGDMKFLHFSY, (SEQIDNO:1801); XM_532156.6, CDC5L, Del, A_7, KSLHLVSTILLRKTTRLLMQISEN, (SEQIDNO:1802); XM_014116402.1, DDX42, Del, A_7, KSLILFLQLIIQRLTIHHLKKIFTMSMKR, (SEQIDNO:1803); XM_005633718.2, NCR3LG1, Ins, A_7, KSLILYLKSFSSEHPK, (SEQIDNO:1804); XM_014113360.1, CEP85L, Del, A_7, KSLKRSKNSVKKRRHS, (SEQIDNO:1805); XM_533945.4, SAFB2, Del, A_7, KSLKTLRRKKKMRMSRNQDLQIGPESPNPEAEEWNGRS, (SEQIDNO:1806); XM_005629178.2, NAV3, Del, A_7, KSLLGFQVPLGCQLQAAAARSKEPLI, (SEQIDNO:1807); XM_014113193.1, ATM, Del, A_7, KSLLKRNMKLSWISAKNFSQFSVTSAWKSSWTQLFGLRSDWLILAVWPLPRLLVTY LDMDMC RIS, (SEQIDNO:1808); XM_003431655.3, PNRC1, Del, A_7, KSLLKTLRILKICI, (SEQIDNO:1809); XM_005639514.2, ZBTB20, Del, A_7, KSLMSALSATRLSPPNRTTSSTCSYTQVRSPTNAASVGAPSP, (SEQIDNO:1810); XM_003639998.2, CFAP58, Del, A_7, KSLNQRLS, (SEQIDNO:1811); XM_543244.5, LOXL2, Del, A_7, KSLNTSVDS, (SEQIDNO:1812); XM_005615711.2, HDDC2, Del, A_7, KSLPTWPCVPLRPNHPEAWHPCPTLESCTKLTTPRPGLYYHCGPSPSISSGTGESPGR AGYTEASRGRRVYRITCTEWQLWLW, (SEQIDNO:1813); XM_014110775.1, FASTKD1, Del, A_7, KSLQFCINIWMTINHSSY, (SEQIDNO:1814); XM_536509.5, TARS, Del, A_7, KSLRKNRLLKDWK, (SEQIDNO:1815); XM_014117390.1, MTERF2, Del, A_7, KSLRLTLAKFRPKKEGRYLTLWHH, (SEQIDNO:1816); XM_005637371.2, ADIPOR2, Del, A_7, KSLRNMSAMMKLLRKMRGLWVCPLFYKPIMLWKEWKNLFVRYGKVDGE, (SEQIDNO:1817); XM_005630127.1, E2F6, Del, A_7, KSLRTIFDG, (SEQIDNO:1818); XM_014112221.1, FAM172A, Del, A_7, KSLSQKDME, (SEQIDNO:1819); XM_003434864.3, CREBBP, Del, A_7, KSLSQRSYARL, (SEQIDNO:1820); XM_843829.4, PANK1, Del, A_7, KSLTALITHTLCCW, (SEQIDNO:1821); XM_005630596.1, APOB, Del, A_7, KSLTDSLWTFRTRKSLRSLSLAT, (SEQIDNO:1822); XM_005637776.2, FAM45A, Del, A_7, KSLTQRLPGEWGPSEKKRTQMEKFCGCGVILPRQLL, (SEQIDNO:1823); XM_014107044.1, PLCB4, Del, A_7, KSMETKLII, (SEQIDNO:1824); XM_546107.5, TFAM, Del, A_7, KSMKMLIGQTGRHTKKR, (SEQIDNO:1825); XM_853581.4, SEC31A, Del, A_7, KSMLLRLNLKNMCGPF, (SEQIDNO:1827); XM_003432357.3, DNAJC24, Del, A_7, KSMTCSGMKTI, (SEQIDNO:1830); XM_005631157.2, DNAJC24, Del, A_7, KSMTCSGMMITLF1, (SEQIDNO:1831); XM_005633892.2, LRRC63, Del, A_7, KSNLRILTLILFFGKKIH, (SEQIDNO:1832); XM_014116842.1, SMG6, Del, A_7, KSNMRNWN, (SEQIDNO:1833); XM_005634227.2, EPM2AIP1, Ins, A_7, KSNTLCSLQRSC, (SEQIDNO:1834); XM_014109094.1, KIF20B, Ins, A_7, KSPDPGTGTTN, (SEQIDNO:1835); XM_549024.5, LOC491904, Ins, A_7, KSPDVHISPHLHHG, (SEQIDNO:1836); XM_005623486.2, SYNE2, Del, A_7, KSPFWISCQ, (SEQIDNO:1837); XM_844339.5, PAK2, Del, A_7, KSPGIKSSLYSPAQRKEVRRKKRNGQKFLLHLILSIPSMLALMRLRENLLACQNSGLD YRRPPISPN, (SEQIDNO:1838); XM_014117059.1, MAPKAP1, Del, A_7, KSPLKRNRQVLESSQYYLYDWSSALCS, (SEQIDNO:1839); XM_005616994.2, ARHGAP21, Del, A_7, KSPLLQERSVSDWMIVHQHIPIGIFH, (SEQIDNO:1840); XM_014114325.1, GNA12, Del, A_7, KSPLRWWTWVARGLSARSGSSASTESHRSCSWCPPVSTTRCSWRTGAPTGWWSP, (SEQIDNO:1841); NM_001194952.1, PLAU, Ins, A_7, KSPLSSRKSRVSMWPEGSEAS1, (SEQIDNO:1842); XM_546967.5, LOC489848, Del, A_7, KSPPQEREAQGRRAKVWEEASA, (SEQIDNO:1843); XM_005626549.2, JADE2, Del, A_7, KSPQRFSGQT, (SEQIDNO:1844); NM_001313825.1, MEPE, Del, A_7, KSPVILKAVVTQIFKRGGTMISLLSAEMVNLLRTFLVRENLLVLT, (SEQIDNO:1845); XM_005640898.1, PEA15, Del, A_7, KSPWRTWSSSSRPARRTSPARRARRSRPAAPGSASWRATTSWTKITSRTSSTSLRSPA APTSSPWWWTTEPAS, (SEQIDNO:1846); XM_014111645.1, RPS6KA3, Del, A_7, KSQALMLDSFMP, (SEQIDNO:1848); XM_014114831.1, CCDC18, Del, A_7, KSQEIRCLFHLPPWIRRSEVFERNLTNSDNRMLVWSHRIIL, (SEQIDNO:1849); XM_533808.5, IQCF1, Del, A_7, KSQETKMSPLPVIRKS, (SEQIDNO:1850); XM_005629880.1, NRG1, Del, A_7, KSQGSQNFALAKHHWLILENICAK, (SEQIDNO:1852); XM_003431985.3, PLXNC1, Del, A_7, KSQILMSYIFGKQTAFLFASG, (SEQIDNO:1853); XM_005637042.2, ITPR2, Del, A_7, KSQKNSSKFSMTE, (SEQIDNO:1854); XM_005638154.2, E2F5, Del, A_7, KSQKTVYNGKV, (SEQIDNO:1855); XM_849701.4, FGD6, Del, A_7, KSQLLSKKYQQTQKILP, (SEQIDNO 1856); XM_014107587.1, NC1, Del, A_7, KSQLPHQPRKQLSPLAKRQQLHQPKRRLHQPKQ, (SEQIDNO:1857); XM_536323.5, HMGCR, Del, A_7, KSQMIVVDVNLCWSGIATKSMQQRRRQG, (SEQIDNO:1858); XM_845208.4, HECTD1, Del, A_7, KSQQKFCSRLRNHWPWQVELYQTGVNS, (SEQIDNO:1859); XM_005634020.2, UGGT2, Del, A_7, KSQTKLRRISLPIKMKRKKECGIPLKVSQEGCTKKKTKTKQIF, (SEQIDNO:1861); XM_014116333.1, C9H17orf80, Del, A_7, KSQTSRILKRES, (SEQIDNO:1862); XM_014120571.1, LOC607974, Del, A_7, KSRASGSKLASIGLSLSMTYSL, (SEQIDNO:1864); XM_014110816.1, USP48, Ins, A_7, KSRCAEHCPTAVLWRICLRNRLQSMWQRV, (SEQIDNO:1865); XM_534241.4, TOP2B, Ins, A_7, KSRFWESLLISFILSEVRR, (SEQIDNO:1866); XM_005627906.2, ATAD2, Ins, A_7, KSRIQYFSVGKFICSNQPVYLSASHGL, (SEQIDNO:1867); XM_859377.4, UPF3B, Del, A_7, KSRKVVLAIEKKEERS, (SEQIDNO:1868); XM_005631997.2, PRPF40A, Del, A_7, KSRLLMLTKSRQRKKKKKRQDQNTKRPRNHFNVFLKIMRK, (SEQIDNO:1869); XM_005627765.2, CAPN11, Del, A_7, KSRNGRTSSESVTRTTRAA, (SEQIDNO:1870); XM_850237.2, CLCA2, Ins, A_7, KSRQEREWNKINM, (SEQIDNO:1872); XM_014112822.1, ANK3, Del, A_7, KSRRASCLCTRSLLEKSSRRP, (SEQIDNO:1873); XM_014114127.1, CCT6A, Ins, A_7, KSRRCIHPHMQCVLRV, (SEQIDNO:1874); XM_014115168.1, LOC480059, Ins, A_7, KSRRCIHPHMQCVVRV, (SEQIDNO:1875); XM_532236.6, UFL1, Del, A_7, KSRRKEEKKRIVMMSHLTLERRSQRSLSCSRMRLKTF, (SEQIDNO:1876); XM_014116489.1, HEATR9, Ins, A_7, KSRRNINSGGFN, (SEQIDNO:1877); XM_861964.4, CLK3, Del, A_7, KSRRRTKRTNSCVS, (SEQIDNO:1878); XM_014112077.1, MAN2A1, Ins, A_7, KSRSETSVRLGY, (SEQIDNO:1879); NM_001205203.1, MEF2B, Del, A_7, KSRSRAFWTKGIGR, (SEQIDNO:1880); XM_003433570.1, SLC15A5, Del, A_7, KSRTGCFT, (SEQIDNO:1881); XM_014117962.1, LOC102153482, Ins, A_7, KSRVQGVADFGQGSQPPRLLILCSP, (SEQIDNO:1882); XM_532843.5, SNX25, Del, A_7, KSSCLLLASCLSNL, (SEQIDNO:1883); XM_531679.5, ZFC3H1, Ins, A_7, KSSERRGFLSYVQILHLTKSRR, (SEQIDNO:1884); XM_014116966.1, RALGDS, Del, A_7, KSSGSPPPSHPRRPPASAQPPAAPPPPQPPPRPCPPHAPTSAPSQGSAATAPHCRSTTSR WATAASSSASAWTWTTATCTRASW, (SEQIDNO:1885); XM_532840.5, CCDC110, Ins, A_7, KSSIRHTH, (SEQIDNO:1886); XM_005634448.1, TOPBP1, Del, A_7, KSSKDKNQALLRGHLVGGRLSYMLTSPEKQDSNAFFSQEEQRYYMLYLYLKKLHIS FLTSIN, (SEQIDNO:1887); XM_534297.5, U2SURP, Ins, A_7, KSSKSVIQ, (SEQIDNO:1888); XM_005639335.1, CYP2U1, Del, A_7, KSSKTIKSL, (SEQIDNO:1889); XM_847262.4, MRPS23, Del, A_7, KSSLCKKFHRTRIRRLLKNSRKVSHLP, (SEQIDNO:1890); XM_014108490.1, GPR19, Del, A_7, KSSLGPLIQIHQILLC, (SEQIDNO:1891); XM_535303.4, RBL2, Del, A_7, KSSLKEKKKILQGF, (SEQIDNO:1892); XM_014116985.1, SETX, Del, A_7, KSSLNLKKNVKTRRILWETVEI, (SEQIDNO:1893); XM_005632646.2, ZDHHC3, Del, A_7, KSSPLKSVPQSAAPSRHLPQ, (SEQIDNO:1895); XM_005622426.1, RGL1, Del, A_7, KSSPSLPRRVPLSIPWTPLPQGCRP, (SEQIDNO:1896); XM_014106956.1, ADNP, Del, A_7, KSSPTNASIALVYTPAT, (SEQIDNO:1897); XM_845288.4, ENTPD7, Del, A_7, KSSQESLQWQTPRNMPVITFVLC, (SEQIDNO:1898); XM_014114569.1, LOC489979, Del, A_7, KSSRNILLFTDLFLSCSHLLSSITGVLYMKLHMIYLLTVMWQKIL1R1, (SEQIDNO:1899); XM_005621408.2, RBBP6, Del, A_7, KSSSTEKLVKKLEVQKMYLIQKNPLKN, (SEQIDNO:1900); XM_014122800.1, BBOX1, Ins, A_7, KSSSVPDFVLHFCGLYRHWSGLL, (SEQIDNO:1901); XM_014122806.1, ZNF214, Del, A_7, KSSTERSCGRTTQMSCQ, (SEQIDNO:1902); XM_537580.5, CEP112, Del, A_7, KSSTMLSQKWKRKSLIFKSGTRKIFKNCSRTQTCV, (SEQIDNO:1903); XM_533351.4, KIF5C, Del, A_7, KSSVGSFI, (SEQIDNO:1904); XM_003434950.3, C4BPA, Del, A_7, KSSVLGQRLEMEK, (SEQIDNO:1905); XM_005630991.2, CCDC146, Del, A_7, KSSWNMNSKN, (SEQIDNO:1906); XM_014115665.1, ZBTB1, Del, A_7, KSSYLNILPVLFDVLIVASGLKPKI, (SEQIDNO:1907); XM_014112259.1, WDR41, Ins, A_7, KSTDLDSLF, (SEQIDNO:1908); XM_848248.5, KCTD8, Del, A_7, KSTFQIISQSANASGNRNCCRSMGY, (SEQIDNO:1909); XM_005620921.2, SUMF2, Del, A_7, KSTGQRLRCSGGVLSLRSLSPMSLETK, (SEQIDNO:1910); XM_545800.5, OCA2, Del, A_7, KSTGYQTRFCSPNA, (SEQIDNO:1911); XM_535814.5, TTC14, Del, A_7, KSTIGGGSQVLRGVPLHQQAQTTLVSQLKNLKNTLILDHVISVDMSKDIS, (SEQIDNO:1912); XM_014115681.1, RALGAPA1, Del, A_7, KSTKGKELDMNFRKFQLTSHFLEDGVVISLAKPQ, (SEQIDNO:1913); XM_014108499.1, KRAS, Del, A_7, KSTKKKRLLAV, (SEQIDNO:1914); XM_005634045.1, GPR183, Del, A_7, KSTLPLYIQQIW, (SEQIDNO:1915); XM_005615655.2, AKAP7, Del, A_7, KSTPNSMKNLSVIHLEKKWYIA, (SEQIDNO:1916); XM_005628257.2, LOC482176, Del, A_7, KSTRQKQTTL, (SEQIDNO:1917); XM_545105.5, QTRTD1, Del, A_7, KSTRRTLIH1, (SEQIDNO:1918); XM_005641214.2, POLA1, Ins, A_7, KSTSCTCCPLDEFSRRQKNESWRYCVICHLSGWVKPHCESEGLCT, (SEQIDNO:1919); XM_014112808.1, SYNE1, Del, A_7, KSTVVISSW, (SEQIDNO:1920); XM_005640463.2, GLS, Del, A_7, KSVFQKAQTWLVY, (SEQIDNO:1922); XM_532130.5, DNAH8, Del, A_7, KSVGMWLVCCLGHLLWQHFMVSIEKCCP, (SEQIDNO:1924); XM_014114457.1, OPYD, Del, A_7, KSVNSCLSCPHGRLN, (SEQIDNO:1925); XM_014115338.1, ASHIL, Del, A_7, KSVQTSTWMSNPFLVTRPPPVTVRSQRMTPGRAVWMTASIE, (SEQIDNO:1926); XM_005641551.2, PCDH19, Del, A_7, KSVRMTSVWYPGMWRRQTR, (SEQIDNO:1927); XM_014109172.1, PRKDC, Del, A_7, KSWAFQGTK, (SEQIDNO:1928); XM_014110675.1, LUZP1, Del, A_7, KSWEDLELRPQRRSRNPPPSQGQTR, (SEQIDNO:1929); XM_005630442.2, ZC3H6, Ins, A_7, KSWFLQGL, (SEQIDNO:1930); XM_533729.5, MRPS25, Del, A_7, KSWGRTRKPWKRRSRRKSSFLTQPTSGPESTACGSVSARWRGRSPARACCHYPRS, (SEQIDNO:1931); XM_014116764.1, ATAD5, Del, A_7, KSWKILIFKWFQIHSHILIKEVFLRRKVKS, (SEQIDNO:1932); XM_005638207.2, ZNF770, Del, A_7, KSWLNLNVLGVRN, (SEQIDNO:1933); XM_014113086.1, C1H6orf118, Del, A_7, KSWNRSSRKCVYATLSNSTDCTSSEKSLKTFAIVL, (SEQIDNO:1934); XM_014112240.1, XRCC4, Ins, A_7, KSWNRTENGFSGTPASRKEA, (SEQIDNO:1935); XM_005618153.2, XRCC4, Ins, A_7, KSWNRTENGFSGTPASRKEKLELSPN, (SEQIDNO:1936); XM_005628737.1, LOC102153873, Del, A_7, KSWRMVPSS, (SEQIDNO:1937); XM_014118119.1, PHIP, Ins, A_7, KSWRQKTKKEDEDTKTRFRSHSSYKC, (SEQIDNO:1938); XM_014115723.1, ADSSL1, Del, A_7, KSWWKGPKQPSLILTSGGGRTPL, (SEQIDNO:1939); XM_005618243.2, TLR10, Ins, A_7, KSYFREFQDNFIT, (SEQIDNO:1940); NM_001253787.1, OAS1, Del, A_7, KSYGVAVICWRLGLRTWRSSRE-SPTLLSSPSRPGGPQRSSLSPSCLPTGPWGLLLPTLS HILRSMRV, (SEQIDNO:1941); XM_539571.5, LOC482454, Ins, A_7, KSYKKKTL, (SEQIDNO:1943); XM_014111941.1, PPEF1, Del, A_7, KSYKSWKM-SIPGSQLVQSLTVKSWSSMVVYQSPQT, (SEQIDNO:1944); XM_014118548.1, RGS22, Del, A_7, KSYLQPHHLLQTSSLLLPLCL, (SEQIDNO:1945); XM_014120076.1, BAG4, Del, A_7, KSYMCWRRSSIS-SKK, (SEQIDNO:1946); XM_532831.5, FGL1, Del, A_7, KTAAMHNINFSKLEMKRIPMS, (SEQIDNO:1947); XM_003638871.2, PTCH1, Del, A_7, KTAASSWLWAS-SYLGPSLWD, (SEQIDNO:1948); XM_533512.5, C1H9orf64, Del, A_7, KTAER-SIPFFWIITCGTTPVITGKT, (SEQIDNO:1949); XM_014118520.1, LRP12, Del, A_7, KTAFFASQEI-FIVKTIGVCLKAGCVILRMTAVMAAMRRI-AQLLCLPES, (SEQIDNO:1950); XM_005631997.2, PRPF40A, Ins, A_7, KTAIRVSVCLRTFF, (SEQIDNO:1951); XM_005618779.2, RYR2, Del, A_7, KTAPCRLY, (SEQIDNO:1952); XM_014113043.1, TTC1, Del, A_7, KTCQKRRNRKEEKRALD, (SEQIDNO:1954); XM_014120242.1, DNAH6, Del, A_7, KTCSL-LIIICDQLFLK, (SEQIDNO:1955); XM_005618915.2, RTKN2, Ins, A_7, KTCSPSSF, (SEQIDNO:1956); XM_014114037.1, RYDIN, Del, A_7, KTCWSNLTLPTEVI, (SEQIDNO:1957); XM_861118.4, PTPRE, Del, A_7, KTDIPTSFPMIIPG, (SEQIDNO:1958); XM_005634774.2, ESF1, Ins, A_7, KTEEETEGSC, (SEQIDNO:1959); XM_014119186.1, FAM133B, Ins, A_7, KTEKEKRKEEIW, (SEQIDNO:1960); XM_005641359.2, GSPT2, Del, A_7, KTEKLGICPGP, (SEQIDNO:1961); XM_547403.4, BATF3, Del, A_7, KTELLLREVGRSR-PRRLTNSTRSMSAWSKRTPCCGERLGS, (SEQIDNO:1962); XM_860109.5, RBM39, Del, A_7, KTELQQWQTIYKREVID1, (SEQIDNO:1963); XM_014122498.1, NUMA1, Del, A_7, KTENIPLLRNA, (SEQIDNO:1964); XM_014122749.1, ARHGAP42, Del, A_7, KTERCWTS, (SEQIDNO:1965); XM_005633338.2, CWC15, Del, A_7, KTETVQQENIQPPRRCQRSLG, (SEQIDNO:1966); XM_014106902.1, LOC106557681, Del, A_7, KTFHIITV, (SEQIDNO:1967); XM_005625641.2, CAPS2, Del, A_7, KTFIVISVDEEKGSSTNSVIFMSVET, (SEQIDNO:1968); XM_005618176.2, PAPD4, Del, A_7, KTFLLTVNGNVSIHPTKNQ1, (SEQIDNO:1969); XM_014119514.1, ZMYM4, Del, A_7, KTFLNS-LIRFLSLNQYGKILV, (SEQIDNO:1970); XM_014115463.1, ZNF420, Del, A-7, KTFMKQNYPNGK, (SEQIDNO:1971); XM_005623362.2, PRPF39, Del, A_7, KTFPNQER-CFWKQSKETKKIQSYTSIYLKWNIVVTSNKMKKIS, (SEQIDNO:1972); XM_543400.5, NAA25, Ins, A_7, KTGDHKETKNL, (SEQIDNO:1973); XM_005628809.2, PTPRZ1, Del, A_7, KTGERSTQRVVAPNSLPSILMKIL-PKST, (SEQIDNO:1974); XM_544956.5, THAP9, Ins, A_7, KTGLCKKL, (SEQIDNO:1975); XM_534457.5, ATP9A, Del, A_7, KTGLVSCGRISWTGRQIGSCGSPW-PARRGSPLLPISFRFDHMSMQKSQISTFTTLWEL LPERTATLRSARV, (SEQIDNO:1976); XM_014112420.1, TICRR, Del, A_7, KTGQLNLPSLHGFQFCHLMPL, (SEQIDNO:1978); XM_005627482.2, KLHL31, Del, A_7, KTHLPKGWISMISRRQAWLLLSPMPTLES, (SEQIDNO:1979); XM_005640714.2, EPHA4, Del, A_7, KTHQSEPTKCAT, (SEQIDNO:1980); XM_014118696.1, LOC484323, Del, A_7, KTHTDVINMRTCLVKNQD, (SEQIDNO:1981); XM_014115969.1, PPP1R36, Del, A_7, KTHWKNNPKAIWWAL, (SEQIDNO:1982); XM_014118218.1, REV3L, Del, A_7, KTICHLSES, (SEQIDNO:1983); XM_014115880.1, MIS18BP1, Del, A_7, KTIKVKVALSGAISRKKQLKLIFQLQHQEKKPCLTKN, (SEQIDNO:1984); XM_539574.5, ZFP69B, Del, A_7, KTINIRYLEREIDTI, (SEQIDNO:1985); XM_005615889.2, DOCK8, Del, A_7, KTKEVRR-FAALKRLDPEEIFTRHFRNRRLSQSPWRAMNQAHR-CAPAT, (SEQIDNO:1986); XM_537881.5, OSBPL1A, Del, A_7, KTKFCQKHWRLWPPSIMN, (SEQIDNO:1988); XM_003434415.3, SLF1, Del, A_7, KTKISG-KIWDFLK, (SEQIDNO:1989); XM_542579.5, CCDC122, Del, A_7, KTKKFYYICRVNSVSLKTK, (SEQIDNO:1990); XM_003639701.3, NIFK, Ins, A_7, KTKKKQSV, (SEQIDNO:1991); XM_014120092.1, TEX15, Del, A_7, KTKQNSAIQFYFQIYK (SEQIDNO:1993); XM_014114898.1, LRRIQ3, Del, A_7, KTKRLKTVC, (SEQIDNO:1995); XM_003434478.3, CCDC152, Del, A_7, KTKRLQFSVIPFTI, (SEQIDNO:1996); XM_014120532.1, ZC3H8, Del, A_7, KTKTLKL-FRKMVNRRK, (SEQIDNO:1998); XM_533539.4, KIAA0020, Del, A_7, KTKTPAKE, (SEQIDNO:1999); XM_014107179.1, AURKA, Del, A_7, KTKTQLANS1, (SEQIDNO:2000); XM_014120520.1, BCL2L11, Del, A_7, KTKWQSNLQM, (SEQIDNO:2001); XM_014108547.1, LRRK2, Del, A_7, KTLCGEDVVQNFSHFLMISPFRN-SLRQRQISCFLMQHSVIPTS, (SEQIDNO:2002); XM_005627781.1, AIM1, Del, A_7, KTLDPKVPVLMC, (SEQIDNO:2003); XM_003432496.2, C1H18orf63, Del, A_7, KTLGPVKI, (SEQIDNO:2004); XM_005617102.2, PTER, Del, A_7, KTLIPIKRIFS, (SEQIDNO:2005); XM_014108953.1, ZNF518A, Del, A_7, KTLKCLKK, (SEQIDNO:2006); XM_536371.4, TET1, Del, A_7, KTLKIIYRVWLHD, (SEQIDNO:2007); XM_005618919.2, RTKN2, Del, A_7, KTLKRQMDSFLL-VSMKNPHHLFGPASLMVIIKWLSRKRSEFWMGSS, (SEQIDNO:2008); XM_005618918.2, RTKN2, Del, A_7, KTLKRQMDSFLL-VSMKNPHHLFGPASLMVIIKWLSRKRSEFWMGSSGL-SA, (SEQIDNO:2009); XM_005618915.2, RTKN2, Del, A_7, KTLKRQMDSFLLVSMKNPHHLFGPA-SLMVIIKWLSRKRYYLLQASSYMMGKGKKD VLP-FLLLIKLHSA, (SEQIDNO:2010); XM_005638410.2, DMXL2, Del, A_7, KTLLIKLIL, (SEQIDNO:2011); XM_014109094.1, KIF20B, Del, A_7, KTLLLMFKYNT, (SEQIDNO:2012); XM_532397.5, CABS1, Del, A_7, KTLLRKETTLLQ, (SEQIDNO:2013); XM_544755.5, MYO9A, Del, A_7, KTLMDQSIMVVCSHGYG, (SEQIDNO:2014); XM_005633353.2, MRE11A, Del, A_7, KTLMKKMMKFERL, (SEQIDNO:2015); XM_005619751.1, NXPE4, Del, A_7, KTLSLLFLWASIS-GPSPLMFLSEGPSMSTKLFSVFF, (SEQIDNO:2016); XM_005623067.2, ARHGAP28, Del, A_7, KTLYQKLKSCPLKYLIQKWLQKFQKEINLR-SQILRKKTTL, (SEQIDNO:2018); XM_014109144.1, LOC607941, Del, A_7, KTMDKRRRWWSRPSAW-GAVRTSGTAQP, (SEQIDNO:2019); XM_014108034.1, MYO1H, Del, A_7, KTMISSTDI, (SEQIDNO:2020); XM_014114822.1, BCAR3, Del, A_7, KTMKAVRLC, (SEQIDNO:2021); XM_014121157.1, SUV420H1, Del, A_7, KTMQLLTENLQLV, (SEQIDNO:2022); NM_001002968.1, SLC10A2, Del, A_7, KTMRNFQRAKTTKRSLSHRSIR, (SEQIDNO:2023); XM_005639890.1, LOC102151275, Del, A_7, KTNGKHGYKKTGRTARI, (SEQIDNO:2024); XM_014116355.1, BPTF, Del, A_7, KTNHIFDMNLL-DMTGVGGNTGS, (SEQIDNO:2025); XM_544755.5, MYO9A, Del, A_7, KTNKIHLILDGMEEL-GFVRADFQVAPPCLIKTGYLLIQLVANCWREPMEF1, (SEQIDNO:2026); XM_014118915.1, CTTNBP2, Del, A_7, KTNKSQNQTNRPAYNSLTLTLC, (SEQIDNO: 2027); XM_014107325.1, BRCA2, Del, A_7, KTNKTPKT, (SEQIDNO:2028); XM_014119627.1, ANO4, Del, A_7, KTNQMDFTSEMESVGLTIFLCTENLTHRPKREKCL-NEILEQKDYKWRKSP1, (SEQIDNO:2029); XM_014112349.1, BOD1L1, Del, A_7, KTNQQTKVKR-SQRAMTKEKERKKRRKRLKRNLITQKGVRNYKK, (SEQIDNO:2030); XM_014116543.1, EZH1, Del, A_7, KTNSFLNTVVSLFLRMRLIDGGRSMTNTCPASSSTST-MIL, (SEQIDNO:2032); XM_014120363.1, PTCD3, Del, A_7, KTPIPTAQ, (SEQIDNO:2035); XM_531770.5, GCC2, Del, A_7, KTPKSSSCL, (SEQIDNO:2036); XM_536098.5, MDM4, Del, A_7, KTPSFLIPATQWN-SWIWPTVLKAKKPYQAWENHQITFLNREQIQKT-WRIARIS, (SEQIDNO:2037); XM_005616781.2, ZNF507, Del, A_7, KTPVWPLPVWSIVFYSSVVVFVASNLPAK-KISWII, (SEQIDNO:2038); XM_014120026.1, WHSC1L1, Del, A_7, KTQENLLLTNTSKLTK, (SEQIDNO:2039); XM_005630615.2, PIP5K1A, Del, A_7, KTQKIWNQILPVW, (SEQIDNO:2040); XM_005628611.2, DNAH11, Del, A_7, KTQTEAPMFL-FASKNVKG, (SEQIDNO:2045); XM_003435066.3, TRAF3, Del, A_7, KTRAYKVCTIRY-VALKLKLRDKKKCFEIMNPKYFICSE, (SEQIDNO: 2046); XM_005636026.2, OAS2, Del, A_7, KTR-DAVSSRKSINS, (SEQIDNO:2047); XM_003434330.2, LEMD1, Del, A_7, KTRHSKKDSRLPTLTQKP, (SEQIDNO:2048); XM_005640790.1, LEMD1, Del, A_7, KTRHSKKTQFLKYKSSRKR, (SEQIDNO:2049); XM_005632154.2, ATG7, Del, A_7, KTRKAAWDRGW, (SEQIDNO:2050); XM_534611.5, IQCA1, Del, A_7, KTRKKMRDGKCHRVCSFP, (SEQIDNO:2051); XM_544123.3, TRPA1, Del, A_7, KTRLKVLNFFLAKE-LTQTSETAT, (SEQIDNO:2052); XM_014121682.1, KBTBD12, Del, A_7, KTRMLKSIGIM-IEETSFGKSYAQLNFESYMLWAVSIMTSML, (SEQIDNO:2053); XM_535344.5, IFI6, Del, A_7, KTRN-MARKAEAPGS, (SEQIDNO:2054); XM_014115652.1, MTHFD1L, Del, A_7, KTRPLSRCLLLFRQVMIT, (SEQIDNO:2055); XM_014112131.1, LOC100688660, Del, A_7, KTRRKQRKKMLPERERR-FRLLNDGKRKRWNILERKIKR-RENMKEQRSRKRRKQLLR KGKIT, (SEQIDNO:2057); XM_005620337.1, USP24, Del, A_7, KTRRMDSSHLS-LIIPSLCGWCQLCVSSTRSPARL, (SEQIDNO:2058); XM_003640140.3, LRRIQ4, Del, A_7, KTRSRRSRRIFST, (SEQIDNO:2059); XM_542038.5, RAD23A, Del, A_7, KTRTWLPTSS, (SEQIDNO:2060); XM_005623084.2, TXNDC2, Del, A_7, KTSCASRVTPPNHQQNPSCLN-RAVALSS, (SEQIDNO:2061); XM_005626701.2, DDX58, Del, A_7, KTSEIVKKK, (SEQIDNO:2062); XM_014113244.1, SSBP3, Del, A_7, KTSHWENRLGFC-TRGGVYFGTFTVQLLKGETLVNIRVKQKPFMITVQQP-PRALCLAT FPPTMGCREAPSLRVSFRVLRGH-SPRRTHSLHLTIPAA, (SEQIDNO:2063); XM_005618160.2, SSBP2, Del, A_7, KTSH-WGNHQDSYILGGVYFGISTVQLQKDGKHV-NIQVKQKPSMIILLCHLGTLEVQG PH, (SEQIDNO: 2064); XM_536304.5, SSBP2, Del, A_7, KTSHWGNHQDSYILGGVYFGISTVQLQKDGKHV-NIQVKQKPSMIIVLQQLPAQC, (SEQIDNO:2065); XM_005626121.2, VRK2, Del, A_7, KTSIVREVLSPA, (SEQIDNO:2066); XM_535238.5, DHX29, Del, A_7, KTSKAKKRLKKK, (SEQIDNO:2067); XM_005624902.2, EFCAB5, Del, A_7, KTSLGIIWPKSGLMLKA, (SEQIDNO:2068); XM_014116087.1, TTLL5, Del, A_7, KTSLQVSS-WGLTQKVLKTATIILIVGQRVTTMQRWKK, (SEQIDNO:2069); NM_001286960.1, PLG, Del, A_7, KTTAVILMVMSMVLGATQ, (SEQIDNO:2071); XM_003433767.3, DIMT1, Del, A_7, KTTESTVRSIIL, (SEQIDNO:2072); XM_014118588.1, CSMD3, Del, A_7, KTTGGVIHFQPVMHYVEEMLEGLVEQSYHLVTRN-FIQIL, (SEQIDNO:2073); XM_547299.4, CLCA1, Del, A_7, KTTIKMPQTHKTEDAISEAHGK, (SEQIDNO: 2074); XM_005630975.2, RELN, Del, A_7, KTTKGITGMSGLSIFSTSYLFSLLRCLT, (SEQIDNO: 2075); XM_014120448.1, EML4, Del, A_7, KTTKKENMLKCLCEVGQLRCSFLLMLKTMMTSE-QNCLLRN, (SEQIDNO:2076); XM_005626304.2, RUFY1, Del, A_7, KTTKLCPA, (SEQIDNO:2077); XM_005638156.1, NECAB1, Del, A_7, KTTKRP-PIWNNL, (SEQIDNO:2078); XM_014109172.1, PRKDC, Del, A_7, KTTLLKSCSRISVIFLTPLSLSFHLL-SPVFRKSVANTQTC, (SEQIDNO:2079); XM_014110420.1, GOLIM4, Del, A_7, KTT-MAKNKKFEMTTAP-KAERNPMRRRRRKKKMGLGLQRNHSEERKC, (SEQIDNO:2080); XM_540382.5, SLC26A4, Del, A_7, KTTMLALLNPSRGGFCLLYFHL, (SEQIDNO:2081); XM_014119438.1, C15H12orf29, Del, A_7, KTTNSIA-GIPQ, (SEQIDNO:2082); XM_014109405.1, LPCAT2, Del, A_7, KTTPSFLLVESEI, (SEQIDNO:2083); XM_844527.4, DMTF1, Del, A_7, KTTQRF-WRINQDLEFQTVIPIPVYSMFRSESPAWKTIQPSLQAP, (SEQIDNO:2084); XM_005634135.2, TMCO3, Del, A_7, KTTSGCCFHCFV, (SEQIDNO:2086); XM_014119556.1, EEA1, Del, A_7, KTTTYRNK, (SEQIDNO:2087); XM_014112996.1, UIMC1, Del, A_7, KTTVKADSSVSWSSLNTRLQMQK, (SEQIDNO:2088); XM_547275.5, DNTTIP2, Del, A_7, KTTVSHHIANQSIN-FRKNAEKNDRKQQVMAGLA, (SEQIDNO:2089); XM_014116355.1, BPTF, Del, A_7, KTTWKQNHVY, (SEQIDNO:2090); XM_005620305.1, KMT2A, Del, A_7, KTTWTSAQLPHPWRRRKPSAFPLLHLALLNIPLPP, (SEQIDNO:2091); XM_014120351.1, CLIP4, Del, A_7, KTVLLNQHFHCLLVMNRNL, (SEQIDNO:2092); XM_003639039.3, L1TD1, Del, A_7, KTVMTWRLF, (SEQIDNO:2093); XM_532840.5, CCDC110, Del, A_7, KTVNFLWRSNK, (SEQIDNO:2094); XM_014114460.1, ZNF326, Del, A_7, KTVRNTEMDTE-WHLRVHFVNSEHLKKKILNYIWKVLHTKKH, (SEQIDNO:2095); XM_535945.5, NOSTRIN, Del, A_7, KTVSSVPGPGSQRA, (SEQIDNO:2096); XM_005627588.2, CEP162, Del, A_7, KTVYWKTSKD, (SEQIDNO:2097); XM_005631628.2, ASRGL1, Del, A_7, KTWELWVPLPWTAKETWPMQPRRVAS-LIRWLAVLGTPHA, (SEQIDNO:2098); XM_532030.5, SVEP1, Del, A_7, KTWMSVSVNHAKMELPVKMV-PIASGANVQQASQGHIVK, (SEQIDNO:2099); XM_014114190.1, ZAN, Del, A_7, KTWPPQKNTPSQVK, (SEQIDNO:2100); XM_005617457.2, CENPH, Del, A_7, KTWRKLTPRLVCSWIT, (SEQIDNO:2101); XM_537131.4, DYRK3, Ins, A_7, KTWSDRWSQ, (SEQIDNO:2102); XM_014111411.1, LOC611589, Del, A_7, KTYLTERLIQISQNILLKSCSIKVIIKKNFNCKY, (SE- QIDNO:2103); NM_001076794.1, MYH4, Del, A_7, KVARRRVLLSRQCQPFSGRI, (SEQIDNO:2104); XM_005624952.2, PAFAH1B1, Del, A_7, KVASLGHSY-CLDPETRLLRCGTSVLACAL, (SEQIDNO:2105); XM_014112347.1, GRK4, Del, A_7, KVAVVKDGGKC, (SEQIDNO:2106); XM_014108830.1, FAM21C, Del, A_7, KVDLHHLLMSWQLESKGKLQARWKRSE-QPCPQEKQNLGRH, (SEQIDNO:2107); XM_014110756.1, BAZ2B, Ins, A_7, KVDRYFQSEL, (SEQIDNO:2108); XM_005638394.2, CEP152, Del, A_7, KVEYLEKNWKRRFILFRESLS, (SEQIDNO:2111); XM_014122578.1, CEP295, Del, A_7, KVFISSFL, (SEQIDNO:2112); XM_005640463.2, GLS, Ins, A_7, KVFSR-RHRHGWYIRLLFPAMLH, (SEQIDNO:2113); XM_533102.5, KMT2E, Del, A_7, KVGK-KNKTFQNVKKPFVKDLGSHQELRVQLQRLILHLM-VQILDGRQKSKHGWIDM KRQIVTNIVRVFRGRHKE, (SEQIDNO:2114); XM_540027.5, STOX2, Del, A_7, KVGLIGSPMESLGHTARHECLKETLRMVLI-WISQVTESMTFVTLLPGHPGRAASSLN TREITSSCI-ATRT, (SEQIDNO:2115); XM_014121431.1, INTU, Del, A_7, KVGNRALERDLWSMACYQEDL1, (SEQIDNO:2116); XM_005616571.2, LOC100684414, Ins, A_7, KVGRPFIMDSDLLNSTVFLLV, (SEQIDNO:2117); XM_014113086.1, C1H6orf118, Ins, A_7, KVGT-GAPESVCMRPSAIQQTAHLQRSL, (SEQIDNO:2118); XM_014114869.1, SPATA1, Del, A_7, KVHFFGKMK-MIELISLEQRTIR, (SEQIDNO:2119); XM_844507.4, AIDA, Ins, A_7, KVHQHQVLCFHGDG, (SEQIDNO:2120); XM_005628565.2, LOC102157031, Del, A_7, KVIFQKQCFTCPT, (SEQIDNO:2121); XM_003433299.3, NUP58, Del, A_7, KVIKQEQDQRIVKH, (SEQIDNO:2122); XM_005620385.2, CCNL2, Del, A_7, KVITIE-ISEGSVLGLTSEQVIATSGITLVTAGIGG, (SEQIDNO:2124); XM_014118548.1, RGS22, Ins, A_7, KVIYSHTIFYKLQVYCFHYVFEKDRIFPQHPDFLH, (SEQIDNO:2125); XM_014118537.1, RGS22, Ins, A_7, KVIYSHTIFYKLQVYCFHYVFEKDRIFPQHPELDHSC-GAS, (SEQIDNO:2126); XM_014118539.1, RGS22, Ins, A_7, KVIYSHTI-FYKLQVYCFHYVFEKDRIFPQHPENF1, (SEQIDNO:2127); XM_005635475.2, PDS5B, Del, A_7, KVKEADHLNLLVEVHQRKSQQ, (SEQIDNO:2128); XM_005628746.2, PPP1R3A, Del, A_7, KVKEELRKWKQKAWKV, (SEQIDNO:2129); XM_014111411.1, LOC611589, Del, A_7, KVKIER-LKVNLVNQTIHEKLTVGFFLLTF, (SEQIDNO:2130); XM_534241.4, TOP2B, Del, A_7, KVKILGISSHFLHTLR-SQKMIQLNLIAMKKILPLFFHRHLV, (SEQIDNO:2131); XM_014110062.1, ZGRF1, Del, A_7, KVKKINLKIN-HIHKKIWY, (SEQIDNO:2132); XM_014118874.1, ABCB1, Del, A_7, KVKKMRRKKRNQLSARLQCFAIQI-GLIGCICWWGQWLPSSMELHSLS, (SEQIDNO:2134); XM_005627906.2, ATAD2, Del, A_7, KVKNTIFFSW-KIYMQ, (SEQIDNO:2136); XM_014119398.1, RAPGEF2, Del, A_7, KVKPILLEEGTS, (SEQIDNO:2137); XM_014112126.1, LOC607401, Del, A_7, KVKSSERKTHSRID, (SEQIDNO:2138); XM_549075.3, ERCC6L, Ins, A_7, KVKYPRGDQI, (SEQIDNO:2139); XM_014115665.1, ZBTB1, Del, A_7, KVLCP-NYLLQKNVCHGALDGVLPVTVVDLALA-VKNYWMSMC, (SEQIDNO:2140); NM_001313780.1, GMPS, Del, A_7, KVLEKMESSVLVWT-TLAHCSGAFRRKKLFCLPMEIV, (SEQIDNO:2141); XM_005635410.2, MRPS31, Del, A_7, KVLG-KICSKGRDLIFLTLRQLLKRHLKQRLHLHSGI, (SEQIDNO:2142); XM_014120784.1, PC10, Del, A_7, KVLIQVSKLMMKIRNINGICLLERGGKLE, (SEQIDNO:2144); XM_005626673.2, FOCAD, Del, A_7, KVLNLCSRHFSKL, (SEQIDNO:2145); XM_005630596.1, APOB, Ins, A_7, KVLQTHFGHSE-QENH, (SEQIDNO:2146); XM_014110473.1, ECT2, Del, A_7, KVLSKSSLIFVKN, (SEQIDNO:2147); XM_014118152.1, CASP8AP2, Del, A_7, KVLTLAL-ITLRTLNLKNTPWNQTVPTPQSQGKLKAAP, (SEQIDNO:2148); XM_540159.5, THUMPD2, Del, A_7, KVNFLKEMLTH, (SEQIDNO:2149); XM_014107431.1, ZNIYM5, Ins, A_7, KVNKSRCI, (SEQIDNO:2150); XM_005627564.1, TTK, Del, A_7, KVNNFFIK1, (SEQIDNO:2151); XM_014110462.1, ZBBX, Del, A_7, KVPAALAPPILDQKVQLLDHYLELLLKFQKLNILI-LLTITSLS, (SEQIDNO:2152); XM_005627009.1, SMAP1, Del, A_7, KVPALKKLQSPLLIF, (SEQIDNO:2153); XM_005618201.2, LOC479005, Del, A_7, KVPGPQAKEWKDLQELDPEQLSPLPLPSY-AGPGGQGRMQISAASCCRSPWMP, (SEQIDNO:2154); XM_005636067.2, GOLGA3, Del, A_7, KVPNQAKFGLWLIIKLKTSVLGVL-VETLQLWTLPGS1, (SEQIDNO:2155); XM_005625871.2, GTPBP1, Del, A_7, KVPRPSEKKEAHLEGQQ, (SEQIDNO:2156); XM_014113440.1, EXPH5, Del, A_7, KVQKRNP-KIVNSPLNQVTAVLLIFWLIRKRMLEIPKP, (SEQIDNO:2157); XM_014111598.1, MBTPS2, Del, A_7, KVQVQVSV, (SEQIDNO:2158); XM_005622377.2, CEP350, Ins, A_7, KVRATARKSLFTDRQFTNSLCEGH-SQSTTRNQKI, (SEQIDNO:2159); XM_014120373.1, ALMS1, Del, A_7, KVRCFLLIKLENPIRLKLNRLSLISIS, (SEQIDNO:2160); XM_860879.4, VPS54, Ins, A_7, KVR-GYRRKETS, (SEQIDNO:2161); XM_005637042.2, ITPR2, Ins, A_7, KVRKILQSS1, (SEQIDNO:2162); XM_846025.3, ADAMTS5, Del, A_7, KVRVTLTW, (SEQIDNO:2163); XM_014121223.1, CCDC73, Del, A_7, KVSAAYCHLSKLQFFNKSVMILQRNLN, (SEQIDNO:2164); XM_003434330.2, LEMD1, Ins, A_7, KVSAIVGLASLCINCDEWTLRAGQSSG, (SEQIDNO:2165); XM_005623486.2, SYNE2, Del, A_7, KVSCKIT-FLSY, (SEQIDNO:2166); XM_005627636.2, MDN1, Del, A_7, KVSCRPGDWSSELIFWKMPIQMS, (SEQIDNO:2167); XM_541074.4, SERPINB3, Ins, A_7, KVSIS-SRIHG, (SEQIDNO:2168); XM_005630977.2, DNAJC2, Del, A_7, KVSLNM, (SEQIDNO:2169); XM_536878.5, CCZ1, Del, A_7, KVSLSPPLSNKKHLRQKPTQNEPSPD-LAKRGCWAAGSLSGSAATTSGAAASEAEVRS PQGGCLWAGRGRLPRLGAGPGWRQRRPGPGPGR-PRRSSSRRRC, (SEQIDNO:2170); XM_005621835.2, WDR47, Ins, A_7, KVSLYYPEAEVFRSSMC, (SEQIDNO:2171); XM_005634713.2, RALGAPA2, Ins, A_7, KVSNYNTKH, (SEQIDNO:2172); XM_005615711.2, HDDC2, Ins, A_7, KVSQLGHVFP, (SEQIDNO:2173); XM_014109263.1, ST18, Ins, A_7, KVSWRGLHTKS, (SEQIDNO:2174); XM_003639255.2, LOC100856208, Ins, A_7, KVTASGNQCSGHGSPGQRFPRYQRT, (SEQIDNO:2175); NM_001003212.1, F8, Ins, A_7, KVTDE-HSF, (SEQIDNO:2176); XM_014116676.1, WDR87, Del, A_7, KVTFCLRT, (SEQIDNO:2177); XM_005631968.2, ORC4, Del, A_7, KVTGLVAAQ, (SEQIDNO:2178); XM_535886.5, MAK, Del, A_7, KVTGQKGTSLHPL, (SEQIDNO:2179); XM_005623743.2, RPS6KA5, Del, A_7, KVTKHSQSK, (SEQIDNO:2180); XM_014115836.1, AKAP6, Del, A_7, KVTPPPQVTSPGMVRLWRPG-MALMNT, (SEQIDNO:2181); XM_014109094.1, KIF20B, Del, A_7, KVTRSRNWNNKLKNYRQN, (SEQIDNO:2182); XM_532494.5, C14H7orf31, Del, A_7, KVTS- MEMIL, (SEQIDNO:2183); XM_005624741.2, TEX14, Del, A_7, KVTVAGNLSPKSLKKALGISQRRAIS-CQLFVDLENRALVNNHSPLKEPSTVWKETGA QIPAAMEGLKSPVPEPG, (SEQIDNO:2184); XM_014118119.1, PHIP, Del, A_7, KVVEAENQKGR, (SEQIDNO:2185); XM_537573.5, ABCA5, Del, A_7, KVVFRKFFFHYFFYFG, (SEQIDNO:2186); XM_005622125.1, SYDE2, Del, A_7, KVVQLTGLSQIK, (SEQIDNO:2187); XM_005639188.2, MMRN1, Del, A_7, KVVWLQMRETRLFKCRY, (SEQIDNO:2188); XM_014120481.1, SELV, Del, A_7, KVWNSNFQTVYS-LRRRELPRLQGSLKCLWMENW-SIQRRKVMVLWMRPGCRRL, (SEQIDNO:2189); XM_014108479.1, KIF21A, Del, A_7, KVWPVKRHQTLTKRRKKKRVLQKEKTMN, (SEQIDNO:2190); XM_005621519.2, KIAA0430, Ins, A_7, KVWTQVECVGFI, (SEQIDNO:2191); XM_005641214.2, POLA1, Del, A_7, KVYLMYMLPSG, (SEQIDNO:2192); XM_005638229.2, EIF2AK4, Del, A_7, KWAR-SLPVKRRRRLISAKSRFKGQKRNSTHW, (SEQIDNO:2193); XM_014109944.1, WDFY3, Del, A_7, KWCE-MICFITITPMCQKRSKRQMWRLRSQVNSLRHLMISF-LKRNPLDTEEP, (SEQIDNO:2194); XM_014109945.1, WDFY3, Del, A_7, KWCEMICFITITPMCQKR-SKRQMWRNPLDTEEP, (SEQIDNO:2195); XM_846266.3, PHAX, Del, A_7, KWDQRKRKMGKVIS-NGNDLSKTD, (SEQIDNO:2196); XM_005616957.2, LOC480753, Del, A_7, KWDVRLMDYKRSYQKQKK, (SEQIDNO:2197); XM_014121431.1, INTU, Ins, A_7, KWETGHWRETCGPWPATRRICYEEWSDINW, (SEQIDNO:2198); XM_003431865.4, THSD7A, Del, A_7, KWFSRKPAPSLAQVTVI, (SEQIDNO:2199); XM_005640267.2, XIRP2, Ins, A_7, KWFS-SITVPRDDKG, (SEQIDNO:2200); NM_001287021.1, IL6ST, Del, A_7, KWGKMKLS, (SEQIDNO:2201); XM_533102.5, KMT2E, Ins, A_7, KWGKRTKHFKM, (SEQIDNO:2202); XM_539311.4, ADAMTS3, Ins, A_7, KWKDSCCLQEISRRTGSHKHVPRLPIQRVESGRP, (SEQIDNO:2203); XM_005623031.2, SMCHD1, Del, A_7, KWKIFKSWGIIH, (SEQIDNO:2205); XM_003638878.3, KIF5B, Del, A_7, KWKKMKRS, (SEQIDNO:2206); XM_014122056.1, FBX015, Ins, A_7, KWKRIHHAAH, (SEQIDNO:2208); XM_535180.5, HSPA14, Ins, A_7, KWKVKIRSRYW, (SEQIDNO:2209); XM_539276.4, CEP135, Del, A_7, KWKVLQLQKENLLWKLKG, (SEQIDNO:2210); XM_540152.4, RMDN2, Del, A_7, KWLLLCLEKYHPQQWKKLCKISLRLKNYTLVFL-SPITCTWPSVTLILNKQIT1, (SEQIDNO:2211); NM_001010944.1, PPT1, Del, A_7, KWLRRKYLEFT-SYL, (SEQIDNO:2212); XM_014110870.1, FSIP2, Del, A_7, KWLTIYKKCKKMALKEKI, (SEQIDNO:2213); XM_005617406.2, GPBP1, Ins, A_7, KWMADAWKKWY, (SEQIDNO:2214); XM_005638410.2, DMXL2, Del, A_7, KWMIYLQNQRF, (SEQIDNO:2215); XM_014115228.1, RGS7, Ins, A_7, KWNSYSYCQKLSFQDT, (SEQIDNO:2218); XM_005638394.2, CEP152, his, A_7, KWN-TWKRIGREDSFSSERA, (SEQIDNO:2219); XM_005624952.2, PAFAH1B1, Ins, A_7, KWQAWAIL-TVWIQRQDY, (SEQIDNO:2220); XM_014111411.1, LOC611589, Del, A_7, KWQLQLRQLLLMRHLLWLT-YHQVIKGWSTRLFTPLYAIFCGNIDLKTPFTRT, (SEQIDNO:2221); XM_005641533.2, HDX, Ins, A_7, KWQNTNYSKGRNQVLSHKYM, (SEQIDNO:2222); XM_850059.4, PARK2, Ins, A_7, KWRNIHA-HEVPTAPVPAGVVLDLQL, (SEQIDNO:2224); XM_014109472.1, RPGRIP1L, Ins, A_7, KWRPFLL-RESRQ, (SEQIDNO:2225); XM_005624391.1, C9H17orf104, Del, A_7, KWRRQYLTSRISHFQKPHHI, (SEQIDNO:2226); XM_005619169.2, NSD1, Ins, A_7, KWRWHSEISTS, (SEQIDNO:2227); XM_014107474.1, LOC477353, Del, A_7, KWSGYCILV, (SEQIDNO:2228); XM_014119574.1, OSBPL8, Ins, A_7, KWSVGWNSSSEC1, (SEQIDNO:2230); XM_005624530.2, KRT222, Del, A_7, KWTKTKRL, (SEQIDNO:2231); XM_014108788.1, MK167, Del, A_7, KWTLMKTFQG, (SEQIDNO:2232); XM_014109323.1, EFCAB1, Del, A_7, KWTMTMMGSCLSQTMNRL, (SEQIDNO:2233); XM_535817.5, MCCCI, Del, A_7, KWVYGPQLCIVRPTGIPCM, (SEQIDNO:2234); XM_003640020.3, MRPL15, Ins, A_7, KWWCCYYSFL, (SEQIDNO:2235); XM_846278.4, MAP4K5, Ins, A_7, KWWLQPA1, (SEQIDNO:2236); XM_545603.5, NBEAL1, Ins, A_7, KYAASAANVSVFTF, (SEQIDNO:2237); XM_014108877.1, HELLS, Ins, A_7, KYAQLQHRSRCIYLLSEYTSWWPGH, (SEQIDNO:2238); XM_543182.3, RNF17, Ins, A_7, KYDSTLSP-TYFA, (SEQIDNO:2239); XM_014116352.1, EFCAB13, Del, A_7, KYESNFELSMKRQYSSVVKKN-PLIFQEKKRSGERKIYKYNCILKELSLPLPQ, (SEQIDNO:2240); XM_014119437.1, CEP290, Ins, A_7, KYFHYRRFEK, (SEQIDNO:2241); XM_014122439.1, DDIAS, Del, A_7, KYFLQKFLDSK, (SEQIDNO:2242); XM_005634466.2, SLC35G2, Ins, A_7, KYFSIQKNVD-SAVWICFGSWMCSSYH, (SEQIDNO:2243); NM_001017533.1, cOR9K3, Del, A_7, KYFYLILS, (SEQIDNO:2244); XM_531939.5, PSIP1, Del, A_7, KYGD-SKLVRLSWKSLQCCITSLRICFWLVKEIL, (SEQIDNO:2245); XM_014111472.1, CYLC1, Del, A_7, KYGIKIIFL, (SEQIDNO:2246); XM_014117777.1, CCDC171, Ins, A_7, KYGKIESY, (SEQIDNO:2247); XM_005639497.2, KIAA2018, Ins, A_7, KYHCLFQWESAWWKQPGN-SCSGDNL, (SEQIDNO:2249); XM_005619458.1, EMB, Ins, A_7, KYHFRTTF, (SEQIDNO:2250); XM_003639447.3, SNX31, Del, A_7, KYHIQQSQKD-SCFLPRNKI, (SEQIDNO:2251); XM_005641549.2, DIAPH2, Del, A_7, KYINLRCP, (SEQIDNO:2252); XM_005622295.2, ZBTB41, Del, A_7, KYIQVRRP-ISVKNVENVLVVGIISLFITKVYTWEKKCGKNTKQPF-INVMFVRKFLKAN QV, (SEQIDNO:2253); XM_014118822.1, REST, Ins, A_7, KYKEEKSEK, (SEQIDNO:2254); XM_539407.5, ZNF804B, Ins, A_7, KYKHHTKPSGKRLTQYLLHKLSNLARQK, (SEQIDNO:2255); XM_014114888.1, FUBP1, Del, A_7, KYKMMLVFEFSLSQMMEQHLIE, (SEQIDNO:2256); XM_014114463.1, LOC106558915, Ins, A_7, KYKPP-PRLDS, (SEQIDNO:2257); XM_005621312.2, AG1, Del, A_7, KYKTTLKSYFMCQKTLQILMKSILTWFTNVAYT-KIVMELPALGVTISSGLILP, (SEQIDNO:2258); XM_005640342.2, KIAA1715, Del, A_7, KYLKKSWKKKLIKRLN, (SEQIDNO:2259); XM_535836.5, KNG1, Del, A_7, KYLLTAQSWRC1, (SEQIDNO:2260); XM_014111704.1, REPS2, Ins, A_7, KYLQKNGR, (SEQIDNO:2261); XM_014106956.1, ADNP, Del, A_7, KYLVTLGWNTVKNT, (SEQIDNO:2262); XM_005627588.2, CEP162, Del, A-7, KYLVVLHY-CLRRTK, (SEQIDNO:2263); XM_014109018.1, HECTD2, Del, A_7, KYPRRGSNNW, (SEQIDNO:2264); XM_014108253.1, MRPS35, Ins, A_7, KYPTNTSPNESC, (SEQIDNO:2265); XM_005624391.1, C9H17orf104, Del, A_7, KYPVLTTLQFQG, (SEQIDNO:2266); XM_014114844.1, HFM1, Del, A_7, KYQIL-HILLRKWISLLETMNVKRKLISACQFLAAA, (SEQIDNO:2267); XM_005621939.2, HFM1, Del, A_7, KYQILHILLRKWISL- LETMNVKRKLISVGIILMMKLMK, (SEQIDNO:2268); XM_005629477.2, LUC7L2, Del, A_7, KYREHRRE-WEILLVNESNSAMTEYARVTF-STVAPMMSSLELEWILENV, (SEQIDNO:2270); XM_535814.5, TTC14, Ins, A_7, KYRGKKRAP, (SEQIDNO:2271); XM_014115182.1, SUCO, Del, A_7, KYRKIEIIMPQ, (SEQIDNO:2272); XM_014110037.1, CDK12, Del, A_7, KYRKMPEIFLYLKNPKTERRKRKRMIP, (SEQIDNO:2273); XM_849319.3, LOC611632, Ins, A_7, KYRQILCFAVFYN, (SEQIDNO:2274); XM_005629294.2, CCDC53, Ins, A_7, KYRRKFRQ, (SEQIDNO:2275); XM_531794.5, TMEM131, Ins, A_7, KYTIQNHC, (SEQIDNO:2276); XM_005628224.2, PAICS, Ins, A_7, KYTKTTLWNTKK, (SEQIDNO:2277); XM_014109133.1, TDRD1, Del, A_7, KYTSWLRIPCP, (SEQIDNO:2278); XM_014119368.1, LRBA, Ins, A_7, KYVFWWNFA TVSPTSVCSGSKELFRVSTAFTAES, (SEQIDNO:2279); XM_014117695.1, FBN2, Del, A_7, KYVLMAQDIPPMEEILMNVR, (SEQIDNO:2280); XM_005617177.2, ASB13, Del, A_7, KYVPMLFFSTLMNPLNVLNLEACYPSRSRGPL, (SEQIDNO:2281); XM_005621538.2, ZC3H7A, Del, A_7, KYVQDQQKQIMRDLIIYVKMLLLRRNVDTQATARSLIAKKR, (SEQIDNO:2282); XM_005622271.2, CAMSAP2, Del, A_7, KYWRKWRSQMPTTF, (SEQIDNO:2283); XM_005622462.2, TDRD5, Ins, A_7, KYWYNKESKAAKLRKFFGFSHIAQVGGVLHFSGRVTAVSRRESV, (SEQIDNO:2284); XM_005627518.2, PHF3, Ins, A_7, MAASSSSKDGTTSFTSEILRRKK, (SEQIDNO:2285); XM_005639761.2, B3GNT5, Ins, A_7, MAVCSALCHLFCTKPHVFLGPNR, (SEQIDNO:2286); XM_005630442.2, ZC3H6, Ins, A_7, MEGYDSGIH, (SEQIDNO:2287); XM_014115009.1, FMN2, Ins, A_7, MFRCCSAGRF, (SEQIDNO:2288); XM_005619006.2, P4HA1, Ins, A_7, MGREVRSTNQHSNKRSRRICWAPCKCIQINETSEH, (SEQIDNO:2289); XM_014112822.1, ANK3, Ins, A_7, MGYQRRKKCYN, (SEQIDNO:2290); NM_001284489.1, DEFB118, Ins, A_7, MLAQIWILQENLQS, (SEQIDNO:2291); XM_854556.3, NRD1, Ins, A_7, MLGSCAIWWKW, (SEQIDNO:2292); NM_001287076.1, LTF, Ins, A_7, MLQIPSEYEKSRWPHCLLYKESLP-PRMYPGYQGKQGRCCDPGWWFGV, (SEQIDNO:2293); XM_003435003.3, LAMA3, Ins, A_7, MLRGLEARAICLILQGWTVEVHRFGSPFAQ, (SEQIDNO:2294); XM_014115649.1, GALC, Ins, A_7, MVYAHVNY, (SEQIDNO:2295); XM_014120092.1, TEX15, Ins, A_7, MYGKDRHSGQNNVEN, (SEQIDNO:2296); NM_001003300.2, KCNMA1, Del, A_7, NAAANGLKMSSHRRCPQKKSSGTEACGTHPAPRPS, (SEQIDNO:2297); XM_014108599.1, RHNO1, Del, A_7, NAANLPGKPSCYSNKNHWRAPNTTMALPSVPSPTLDRCPASPLTTTPSLPGYHLSLI, (SEQIDNO:2298); XM_005633661.2, ZNF143, Ins, A_7, NADCLTRTCNKSNC, (SEQIDNO:2299); XM_005622209.2, KDM5B, Ins, A_7, NADPQKEENQTEPLQGHEQFQVREGA, (SEQIDNO:2300); XM_005618617.2, UGDH, Ins, A_7, NAEASLYL, (SEQIDNO:2301); XM_014111503.1, LOC102153069, Ins, A_7, NAEDGTAVSERGRRGSIPPRRLSHILGR, (SEQIDNO:2302); XM_005634656.1, ARHGEF26, Ins, A_7, NAERTRNI, (SEQIDNO:2303); XM_014117473.1, VPS13A, Ins, A_7, NAFKTIEE, (SEQIDNO:2304); XM_854556.3, NRD1, Del, A_7, NAGLLRYLVEMVRQDLSKILLTQYSAFQLH, (SEQIDNO:2305); NM_001284489.1, DEFB118, Del, A_7, NAGTNLDTAGKPAKLTK, (SEQIDNO:2306); XM_005616483.2, ZNF235, Del, A_7, NAIGVMSVGRVSVRAQTCKLIRESTQGRSPIRALSVVRALTRPHIFMLICLFTQERNPT DVKVVGRASVVAQI, (SEQIDNO:2307); XM_005628918.2, MACF1, Ins, A_7, NAKFRIKTRV, (SEQIDNO:2308); XM_005619413.2, RAIZ14, Del, A_7, NAKLHHLLSVLLS, (SEQIDNO:2309); XM_534306.5, EIF2A, Ins, A_7, NAKLVSILVRR, (SEQIDNO:2310); XM_003434147.2, GPR160, Ins, A_7, NALAQVHYLFSRHLVTICTTSSNYPFT, (SEQIDNO:2311); XM_849749.4, ST3GAL5, Ins, A_7, NALCGPRPCKESSEICSASLAKGVPTQVCEEVDGAVVRAQVQHGLATFREGDPQNE, (SEQIDNO:2312); XM_005639168.2, HERC6, Del, A_7, NALNVKWLRVKLQ, (SEQIDNO:2313); XM_005632905.2, DNMT1, Ins, A_7, NAPGEEKETEQESDLLGWRCCQD, (SEQIDNO:2314); XM_003435003.3, LAMA3, Del, A_7, NAQRTGSSCDLPHSPGMDS, (SEQIDNO:2315); XM_005635030.2, MROH8, Del, A_7, NARGKLTS, (SEQIDNO:2316); XM_546165.5, DNAJC9, Ins, A_7, NASQERKEI, (SEQIDNO:2317); XM_014110776.1, ATF2, Ins, A_7, NASRFIPSCNTYHKKQN, (SEQIDNO:2319); XM_014109639.1, LONP2, Ins, A_7, NASVNARICSD, (SEQIDNO:2320); XM_544733.5, DENND4A, Ins, A_7, NAVEKDGST, (SEQIDNO:2322); XM_005615542.2, SERAC1, Ins, A_7, NAVGSLQEARNECCYKQYQRNYFL, (SEQIDNO:2323); XM_005628719.2, ANLN, Del, A-7, NAVLTTLK, (SEQIDNO:2324); XM_014109133.1, TDRD1, Ins, A_7, NCAEQNNHGESGRQAGKQLPGGARR, (SEQIDNO:2325); XM_005638791.2, LTN1, Del, A_7, NCFASYLKMSLILWRRNLSLFYHRISFGSMENTVYLRSAQLILS, (SEQIDNO:2327); XM_014115086.1, NSL1, Ins, A_7, NCFNKPTVSDLF, (SEQIDNO:2328); XM_005626092.1, LHCGR, Del, A_7, NCHRGKNLPASWMPH, (SEQIDNO:2329); XM_539598.4, CLSPN, Del, A_7, NCIVRLNALFESLRLIFHIICLRIKPFMISSNVNPDPLARGMPWHY, (SEQIDNO:2330); XM_014111818.1, LOC100683280, Ins, A_7, NCNLTQI, (SEQIDNO:2331); XM_014120239.1, SOS1, Ins, A_7, NCKRQWTRS, (SEQIDNO:2332); NM_001005870.1, RXFP2, Ins, A_7, NCLADFRSEESHWKRGGCCKSFLFYSVL, (SEQIDNO:2333); XM_014120276.1, TDRD15, Ins, A_7, NCLEQSNFASSYSKKR, (SEQIDNO:2334); XM_534296.5, PCOLCE2, Del, A_7, NCLQLQYHLLPPRSL, (SEQIDNO:2336); XM_014110770.1, UBR3, Del, A_7, NCLSLKRSRFTLGIHVQQFMM, (SEQIDNO:2337); XM_014119817.1, GALNTL5, Del, A_7, NCNSKLPTDPSKSQDCI, (SEQIDNO:2338); XM_005616720.2, FAM187B, Del, A_7, NCPGAAFN, (SEQIDNO:2339); XM_005619370.2, C9, Ins, A_7, NCPREDIKF, (SEQIDNO:2340); XM_014109455.1, TLN2, Ins, A_7, NCQPLGGGS, (SEQIDNO:2341); XM_005620755.2, PMFBP1, Del, A_7, NCRASNSRAS, (SEQIDNO:2342); XM_544109.5, VCPIP1, Del, A_7, NCRKWFLPSKLRWTSICGIKVQSSHHLIFLKEK, (SEQIDNO:2343); XM_014119322.1, MACF1, Ins, A_7, NCRQTIQAQGLYAKSSEISVACSRPRAMDRRL, (SEQIDNO:2344); XM_005641575.2, ARMCX2, Del, A_7, NCSAPKCHHHLVPFIILMWNQKFLLMPLLYLRSSMTISEQRYSTTENLIKVLFFNVPH LECALRKFEP, (SEQIDNO:2345); XM_014119173.1, AOAH, Ins, A_7, NCSQQENELRSFLRGF, (SEQIDNO:2346); XM_003639982.3, TNKS2, Del, A_7, NCVLFRVSTAETLKGVSLRHSILQLAII-GYLWWSICCNMELTCMLKIKEALYLCTML VLTDIMKLQNFLLSMEQ, (SEQIDNO:2348); XM_014110037.1, CDK12, Ins, A_7, NCYA- RNQVTKATEA, (SEQ ID NO:2349); XM_005639910.2, SKIL, Ins, A_7, NDDRHSRKRENDDQQQDANREEGTLG, (SEQ ID NO:2350); XM_534400.5, EDEM2, Ins, A_7, NDELGAMATSNRGRHVLLT, (SEQ ID NO: 2351); XM_005615498.2, STXBP5, Del, A_7, NDGLSPCPRPLLRKSVKTSMQ, (SEQ ID NO:2352); XM_003639377.3, FAM13B, Ins, A_7, NDKRSFDRRENFSPKKSS1L, (SEQ ID NO:2353); XM_014117407.1, LOC102155766, Ins, A_7, NDRAGKSPAKSQVHVSLRAAPRPS, (SEQ ID NO:2354); XM_014109171.1, PRKDC, Del, A_7, NDVGHEDFHLRHHCVYWIWSSGC, (SEQ ID NO:2356); XM_014120338.1, GEN1, Ins, A_7, NDWNSHEAPPQEFIFSYLIFNTNGRKTGIRYGRGTPEAES, (SEQ ID NO:2357); XM_014112723.1, RYR2, Ins, A_7, NEAAQELPADKWV, (SEQ ID NO:2358); XM_014115128.1, SMG7, Ins, A_7, NEAFSHGAI, (SEQ ID NO:2359); XM_003432681.3, KMT2B, Ins, A_7, NEDGTVVLGT, (SEQ ID NO:2360); XM_005639172.2, HERC5, Ins, A_7, NEDTFRGPRSRAHADSILRWKTIRVQL, (SEQ ID NO:2361); XM_014112808.1, SYNE1, Ins, A_7, NEDVGGFAKRHGKRP, (SEQ ID NO:2362); XM_014117599.1, IFGGB2, Ins, A_7, NEEEFLLCPI, (SEQ ID NO:2363); XM_005638429.2, WDR72, Ins, A_7, NEEFQEDAP, (SEQ ID NO:2364); XM_014110187.1, KALRN, Ins, A_7, NEEKRASCPRGCPASAPAAPPVHHSP, (SEQ ID NO:2365); XM_014119188.1, ABCB4, Ins, A_7, NEENEADWIINFG, (SEQ ID NO:2366); XM_539403.5, ABCB4, Ins, A_7, NEENEADWIINFV, (SEQ ID NO:2367); XM_005638175.2, FGF7, Ins, A_7, NEERTKNSPLSSYGNNI, (SEQ ID NO:2368); XM_531814.5, MSH6, Del, A_7, NEGSYQTLRVTLVALMWNLSQMLRRKEAVMK, (SEQ ID NO:2369); XM_003639581.3, LOC100855940, Ins, A_7, NEICGVKSRATSSRYEF, (SEQ ID NO:2370); XM_005632220.2, RAD18, Ins, A_7, NEILRYFPHNKPLLSIKAGIPRENGA, (SEQ ID NO:2371); XM_014116764.1, ATAD5, Ins, A_7, NEKKEAQRYNRSI, (SEQ ID NO:2372); XM_538964.5, ICK, Ins, A_7, NEKKVLFLGGMHEPSGG, (SEQ ID NO:2373); XM_014116333.1, C9H17orf80, Ins, A_7, NEKNRRHQEY, (SEQ ID NO:2374); XM_014121650.1, MYO3A, Ins, A_7, NELHHWGRG, (SEQ ID NO:2375); XM_005622971.2, WDR64, Ins, A_7, NELNVFAFQTYTSQGL, (SEQ ID NO:2376); XM_014110675.1, LUZP1, Ins, A_7, NEPRLYKECF, (SEQ ID NO:2377); XM_005617055.2, KIAA1462, Ins, A_7, NERDDILFGFHPS, (SEQ ID NO:2378); XM_005624998.1, LOC100687222, Ins, A_7, NERLSAAKKAE, (SEQ ID NO:2379); XM_014109854.1, SAMSN1, Ins, A_7, NESYFLDNEEKSE, (SEQ ID NO:2380); XM_014116764.1, ATAD5, Del, A_7, NEVSTKYFLNVIVNKKVHN, (SEQ ID NO:2381); XM_005615397.2, ME2, Ins, A_7, NEWPFGKVHLYNGNTRKK, (SEQ ID NO:2382); XM_014115682.1, TTC6, Ins, A_7, NFARLPHSYPS, (SEQ ID NO:2383); XM_539103.4, FBXO43, Del, A_7, NFCCAEGWTYLSLF, (SEQ ID NO:2384); XM_014112813.1, BICC1, Ins, A_7, NFCFFKWTCTVSKYKIWCNTHLITWRKSAEWESW, (SEQ ID NO:2385); XM_014112357.1, LCOR1, Del, A_7, NFCKITRRIQNWRILKRL, (SEQ ID NO:2386); XM_843857.4, HNRNPD, Ins, A_7, NFCWWPFSRYT, (SEQ ID NO:2387); XM_535483.5, LYSMD2, Ins, A_7, NFEHPSYIREAFVV, (SEQ ID NO:2388); XM_014116442.1, ABCA5, Ins, A_7, NFEYQRVMYLFCDSIGLHCDH, (SEQ ID NO:2389); XM_014119209.1, CFAP69, Ins, A_7, NFGSYYNSIRKYWQDGCFSSKRDD, (SEQ ID NO:2390); XM_003640173.3, SCN9A, Ins, A_7, NFHSIEQRESNLPFQCHPCFVHAVSIQSSKKNIY, (SEQ ID NO:2391); XM_005636673.2, SLCO1B3, Del, A_7, NFIFMHWCKS, (SEQ ID NO:2392); XM_005638869.2, DNAJC28, Del, A_7, NFLAVHISIP, (SEQ ID NO:2393); XM_545261.4, NMD3, Ins, A_7, NFLLSGTVDFEIWNASEYTSYQRDS, (SEQ ID NO:2394); XM_005636722.1, LOC100687255, Del, A_7, NFLRRKIQLF, (SEQ ID NO:2395); XM_005624758.2, BCAS3, Del, A_7, NFLSQAAIRVQGPT, (SEQ ID NO:2396); XM_014119270.1, LOC102151283, Del, A_7, NFMKQCLLREKIGKD, (SEQ ID NO:2397); XM_014113138.1, C4H5orf42, Ins, A_7, NFMVSNTIKSKTS, (SEQ ID NO:2398); XM_846103.4, LMTK2, Ins, A_7, NFPSAMDRSRISNQLSRQTTNCRSN, (SEQ ID NO:2399); XM_005624045.1, DNAH17, Ins, A_7, NFQFPGRDDKSHPHCGALHHHEPWVRGTHRVARKPKGLVQALRHGRPRL, (SEQ ID NO:2400); XM_014111937.1, CFAP47, Ins, A_7, NFQTERLFKI, (SEQ ID NO:2401); XM_532047.5, CNTR1, Ins, A_7, NFRSGERPSFQAVEW, (SEQ ID NO:2402); XM_539156.5, FAM91A1, Del, A_7, NFSEGKQMFYQ, (SEQ ID NO:2403); XM_005617569.2, CYLD, Ins, A_7, NFSFFGVKYNRFT, (SEQ ID NO:2404); XM_014106569.1, EFHB, Del, A_7, NFSTIETHQLEPKEYFMAEQMILRLLLI, (SEQ ID NO:2406); XM_854584.4, ATF4, Ins, A_7, NGAEQDSSH, (SEQ ID NO:2407); XM_014117118.1, MYRF1, Del, A_7, NGCVLTGFSRPWL, (SEQ ID NO:2408); XM_540152.4, RMDN2, Ins, A_7, NGCYSVWKNTILNSGRSFAKFP, (SEQ ID NO:2409); XM_005626991.2, CCDC180, Ins, A_7, NGDHRRHPWLRPDLEGKTWPEDSVPQLQARHSVRDSSGLY, (SEQ ID NO:2410); XM_005626727.1, DNAI1, Ins, A_7, NGEDGHEEDDIYGVPE, (SEQ ID NO:2411); XM_014114575.1, DNAH3, Del, A_7, NGEMKLHQCTLPCLWPCSALTP, (SEQ ID NO:2412); XM_014119270.1, LOC102151283, Ins, A_7, NGERKASAPWEVQILGLTISHPSHQSSLAITTHDLLFHGASERI, (SEQ ID NO:2413); XM_014114037.1, HYDIN, Ins, A_7, NGFHHEQQPHPAHL, (SEQ ID NO:2414); XM_846266.3, PHAX, Ins, A_7, NGIKGRGKWARSSQTETTCQRQTRGQTRNEL, (SEQ ID NO:2415); XM_539276.4, CEP135, Ins, A_7, NGKFCSYRKRTYSGS, (SEQ ID NO:2416); XM_005631276.2, CKAP5, Del, A_7, NGKRGKKLWRL, (SEQ ID NO:2417); XM_005623031.2, SMCHD1, Ins, A_7, NGKYSKVGELYIEITSCIE, (SEQ ID NO:2418); XM_548222.4, DGKE, Ins, A_7, NGLCSAS1, (SEQ ID NO:2419); XM_014107325.1, BRCA2, Del, A_7, NGLEKENGMINQKE, (SEQ ID NO:2420); XM_014112822.1, ANK3, Del, A_7, NGLPETEKMLQLMP, (SEQ ID NO:2421); XM_014110870.1, FSIP2, Ins, A_7, NGLPFTKNARKWL, (SEQ ID NO:2422); XM_005636851.2, LIMA1, Ins, A-7, NGNVCRRTQA, (SEQ ID NO:2423); XM_005638229.2, EIF2AK4, Ins, A_7, NGPVPYQSREGED, (SEQ ID NO:2424); XM_014116206.1, PCSK5, Del, A_7, NGQRGIMTSVVPSRLTSTIPSGQACGICTAATTRIPANQT, (SEQ ID NO:2425); XM_014117435.1, MAP4K4, Del, A_7, NGQRNFLVL, (SEQ ID NO:2426); XM_005624530.2, KRT222, Ins, A_7, NGQRRRGFKGSASRTQRSSAPVAAPASGN, (SEQ ID NO:2427); XM_547651.5, THOCC Ins, A_7, NGRIKNRRRTCIFCKIFNK, (SEQ ID NO:2428); XM_863511.5, CDC42BPB, Ins, A_7, NGRKIQSRYWTQTSRFSGFNI, (SEQ ID NO:2429); XM_005639761.2, B3GNT5, Del, A_7, NGSLF- SSLPLVLY, (SEQIDNO:2430); XM_005632905.2, DNMT1, Ins, A_7, NGSNQNSSVLQDPSSTVCAVWTVPG, (SEQIDNO:2431); XM_003431865.4, THSD7A, Ins, A_7, NGSRGNLHQALPR, (SEQIDNO:2432); XM_014113182.1, JAK1, Ins, A_7, NGTEALIP, (SEQIDNO:2433); XM_003431657.2, LOC100684448, Del, A_7, NGTSMTDTAKKD, (SEQIDNO:2434); XM_014107908.1, PRR14L, Del, A_7, NGTSPVTCLPCRGSS, (SEQIDNO:2435); XM_537313.5, NDC80, Ins, A_7, NGVRRYFRTVKYNDNRKQERCKNSERRSSKAG, (SEQIDNO:2436); XM_535817.5, MCCC1, Ins, A_7, NGYTVRSCV, (SEQIDNO:2437); XM_005616822.2, ERMP1, Ins, A_7, NHADFNCSVYGHLLPGLQWRILPV, (SEQIDNO:2438); XM_005639666.2, DNAH5, Ins, A_7, NHAENQSVFSGAIEHIDRHHNKRSEFHGTGQI, (SEQIDNO:2439); XM_014111056.1, DNAH7, Ins, A_7, NHEPGLIPICHRTHQQDFQDPEAAPQPRSSGRGRREWKAVCHPVSCPHG, (SEQIDNO:2440); XM_014112831.1, CTNNA3, Ins, A_7, NHGNVQAYMGESYPCPH, (SEQIDNO:2441); XM_005619841.2, GUCY1A2, Del, A_7, NHGTSQVGIRVMSWEA, (SEQIDNO:2442); XM_005618201.2, LOC479005, Del, A_7, NHLNRVLQDK, (SEQIDNO:2444); XM_003639824.3, ACAD11, Del, A_7, NHLVHYFLKHIRLIENSKSRKLCFQLDSPFPNLYCTAVILLSLEQNFT, (SEQIDNO:2445); XM_845208.4, HECTD1, Ins, A_7, NHNKNFAAD, (SEQIDNO:2446); XM_005640898.1, PEA15, Ins, A_7, NHPGGPGAAQVGLQGGHPQREERGDHDRQRLVQLPGEPQQAGQR, (SEQIDNO:2447); XM_005622209.2, KDM5B, Ins, A_7, NHQCCGSVCLPLVWQWQR, (SEQIDNO:2448); XM_535952.5, SSB, Ins, A_7, NHRRSTRISKQMEIKRSQI, (SEQIDNO:2449); XM_014114919.1, LOC100855888, Del, A_7, NHSGVINLGTCFVKHQG, (SEQIDNO:2450); XM_861131.4, PATZ1, Del, A_7, NHSQPSKTWAQHTPAALSSAQPRRDI, (SEQIDNO:2451); XM_014111411.1, LOC611589, Ins, A_7, NHSRGRSS, (SEQIDNO:2452); XM_014120076.1, BAG4, Ins, A_7, NHTCAGEGPVSRARSRRVRREKDRQSVLASGRNANQGAFGTGFS, (SEQIDNO:2453); XM_014109628.1, UNC13C, Del, A_7, NHTNSKEQELESQQIFLLMT, (SEQIDNO:2454); XM_005622326.2, LOC609365, Del, A_7, NHVYIQENPAMAR, (SEQIDNO:2455); XM_547829.5, TMEM260, Ins, A_7, NIC1HRNS, (SEQIDNO:2456); XM_005642422.1, OVCH1, Del, A_7, NIEGHLWAFSPRCIS, (SEQIDNO:2457); XM_005619814.2, DDX10, Ins, A_7, NIERFARSPVPFGN, (SEQIDNO:2458); XM_014122447.1, PCF11, Del, A_7, NIFRIRLIAKMMM, (SEQIDNO:2459); XM_014120092.1, TEX15, Del, A_7, NIFRWCKKRT, (SEQIDNO:2460); XM_014106295.1, MYCBP2, Ins, A_7, NIFTTRASEKTSKDPWQPCSSSCTF, (SEQIDNO:2461); XM_003640018.2, SLC26A7, Del, A_7, NIGTWIKSTGASGSVRTYLQYALLPMWGCCSVWSVP, (SEQIDNO:2462); XM_005631165.2, DCDC1, Del, A_7, NIIHRVKWPKLSLEDSKLLR, (SEQIDNO:2463); XM_014112357.1, LCOR1, Del, A_7, NILKKIQGS, (SEQIDNO:2465); XM_005632452.1, PBRM1, Ins, A_7, NILYEKGRN, (SEQIDNO:2466); XM_544715.5, USP3, Del, A_7, NIMKMHKYP, (SEQIDNO:2467); XM_005638363.2, SPG11, Del, A_7, NINNISRQTR1, (SEQIDNO:2468); XM_532840.5, CCDC110, Ins, A_7, NIPASKGKKLS, (SEQIDNO:2469); XM_014109018.1, HECTD2, Ins, A_7, NIPEEVQTIGREIAAVYFFAPVSCKA, (SEQIDNO:2470); XM_005618024.2, AP3B1, Ins, A_7, NIPSAKTCTTA, (SEQIDNO:2471); XM_014106605.1, GOLGA4, Del, A_7, NISKRSLMHL, (SEQIDNO:2472); XM_014120145.1, PCM1, Del, A_7, NISQLLLQPQLLMGMKPVQANLLLSLQILQEWIMSCGQKCEDMRC, (SEQIDNO:2473); XM_003640060.3, MAP2K5, Ins, A_7, NISQWSDE, (SEQIDNO:2474); XM_005628771.2, IQUB, Del, A_7, NITQKQLLR, (SEQIDNO:2475); XM_005627518.2, PHF3, Ins, A_7, NITRSKFSAGFQTLNSFFE, (SEQIDNO:2476); XM_005620592.1, MTHFSD, Ins, A_7, NIVGPNTTTENRVIQ, (SEQIDNO:2477); XM_542763.5, NR1D2, Del, A_7, NIVSMIYTQWEQGIC, (SEQIDNO:2478); XM_014120276.1, TDRD15, Del, A_7, NIVTKHTVWKRVLK, (SEQIDNO:2479); XM_005627588.2, CEP162, Ins, A_7, NIWWFFIIASGGQNK, (SEQIDNO:2480); XM_014122324.1, ERC2, Ins, A_7, NKAAAGPHGREGDTGRRDSRHEGYVRSEGKKNQCSSEED, (SEQIDNO:2481); XM_845513.2, SSMEM1, Ins, A_7, NKAEPTYSCN, (SEQIDNO:2482); XM_005617106.2, RPP38, Del, A_7, NKAQTNVAQKLIRARI, (SEQIDNO:2484); XM_005624391.1, C9H17orf104, Ins, A_7, NKATKWIL, (SEQIDNO:2485); XM_014113324.1, CCDC15, Ins, A_7, NKCFFKQLECCYWKC, (SEQIDNO:2486); XM_005628711.2, KBTBD2, Ins, A_7, NKCRELCAIVEFC, (SEQIDNO:2487); XM_005615806.2, NAA35, Ins, A_7, NKEKEESSPIEPRDHNEPGISEHVCWNV, (SEQIDNO:2489); XM_005615442.2, AHI1, Ins, A_7, NKEKKESSNFI, (SEQIDNO:2490); XM_014116541.1, LOC102151568, Ins, A_7, NKENLDAGC1HHWARQHlvlALPLPVSSERRRQLYPDVLLHAPLVRDPPLVHGDDHG ALAAYGQHPGLEAARPLAGRHRIR, (SEQIDNO:2491); XM_859339.4, CTCF, Ins, A_7, NKENQKEQTALHRGRQRCGCVCL, (SEQIDNO:2492); XM_014111673.1, LOC492092, Ins, A_7, NKERRGRGCKKKKGGGEESPGEEEEGQGGQETGPEGKRQAPPQETEGQSHSPRCPGA LLFRGVGGEEVPAGSEEGGGSPVATGTLEENCRIHTV, (SEQIDNO:2493); XM_005631123.2, NAT10, Ins, A_7, NKEWDVEHKAG, (SEQIDNO:2494); XM_014115573.1, EPB41L3, Del, A_7, NKFEVVLGTFHLM, (SEQIDNO:2495); XM_005630385.2, NCAPH, Ins, A_7, NKGCYYSDQVHFGEPELESHHSSYRFPL, (SEQIDNO:2496); XM_005619458.1, EMB, Del, A_7, NKGKGNET, (SEQIDNO:2497); XM_005628611.2, DNAH11, Ins, A_7, NKGRLWPSSTGRGLSPRVPPGRCQMGHTVGNHC, (SEQIDNO:2498); XM_005635796.1, SPHKAP, Ins, A_7, NKGSHSGRMELQQGKVTLCFGRQIYWQISSDVDESRRISGKSRRHHFAEPGHIS, (SEQIDNO:2499); XM_014108478.1, KIF21A, Ins, A_7, NKGSTNETNERRTRKSQIDRVQEKQRDCSIEKRST, (SEQIDNO:2500); XM_540152.4, RMDN2, Ins, A_7, NKHFLEEV, (SEQIDNO:2501); XM_014117449.1, LOC102154536, Del, A_7, NKILVCTMKAVLKR, (SEQIDNO:2502); XM_014114967.1, ASPM, Ins, A_7, NKKDDNTHLKTF, (SEQIDNO:2503); XM_005620331.2, C5H1orf141, Ins, A_7, NKKIYLLQK, (SEQIDNO:2504); XM_005639424.2, SENP7, Del, A_7, NKKMTQQYLLNLKSQVKTIKTQKCLKKLHLN1, (SEQIDNO:2505); XM_005623792.2, SETD3, Del, A_7, NKKVCLLLLMEKEKITFLT, (SEQIDNO:2506); XM_005635616.2, CLCN3, Del, A_7, NKKVLWAVLVCVLHSTPRLFQQKVHGH, (SEQIDNO:2507); XM_005627518.2, PHF3, Del, A_7, NKLRKIQKFRVAILVLN1, (SEQIDNO:2508); XM_533859.5, ZDHHC3, Ins, A_7, NKMDEHESRFWPPLLSRLGQPLCHARPREGRPVPVCGL, (SEQIDNO:2509); XM_014115783.1, ZNF793, Del, A_7, NKMNAVDVGNCYSIQTTIEDLMEKDSGNAVIARKL- SATTQHLCINQQ, (SEQIDNO:2510); XM_005619310.2, CSNK1A1, Del, A_7, NKNMKRLVKRRCPLLLKFYVRGFLQNLPCT, (SEQIDNO:2511); XM_014109043.1, CCDC186, Ins, A_7, NKNNSELYFTGRIRHTFFRGI, (SEQIDNO:2512); XM_005627246.2, TAF11, Ins, A_7, NKNRYQRKEREEAKSG, (SEQIDNO:2513); XM_005639205.2, PDLIM5, Ins, A_7, NKPHPGDFSAVGTISSFSTEHA, (SEQIDNO:2514); XM_534105.5, MS4A14, Del, A_7, NKPNCSSPKLCHPKFLHPI1, (SEQIDNO:2515); XM_014109153.1, KNDC1, Ins, A_7, NKQAPRRETR, (SEQIDNO:2516); XM_005629837.1, LOC482849, Ins, A_7, NKRAVLQRGN, (SEQIDNO:2517); XM_014108511.1, PHC1, Ins, A_7, NKRFPRIQLCSCSSAWASPQLLRHRPCQDPGQAPPENL, (SEQIDNO:2518); XM_014108509.1, PHC1, Ins, A_7, NKRFPRIQLCSCSSAWASPQLLRHRPCQDPGQAPPGSRG1, (SEQIDNO:2519); XM_537429.4, FANCM, Ins, A_7, NKRKCFRIP, (SEQIDNO:2520); XM_014108746.1, PIK3C2G, Ins, A_7, NKRNVSCS, (SEQIDNO:2521); XM_850902.4, G3BP2, Ins, A_7, NKSCKRARNQRWW, (SEQIDNO:2522); XM_014107008.1, DIDO1, Del, A_7, NKSCRLLRRKSQNPSMRPLPLSQFLAPLMK, (SEQIDNO:2523); XM_536334.4, HEATR1, Del, A_7, NKSFFISLFLFLQVEGSISF, (SEQIDNO:2524); XM_546398.5, NFRKB, Ins, A_7, NKTDQIRGRGFGRTIKQCRRDPTSLTGPFSAGYTCYQGGAS, (SEQIDNO:2525); XM_014117412.1, LOC100683777, Ins, A_7, NKTPAPTASNKRQPRAPAI, (SEQIDNO:2526); NM_001197076.1, ASPM, Ins, A_7, NKTYCCCGTVYFNLHKTTKNRYS, (SEQIDNO:2527); XM_005624435.2, PSME3, Ins, A_7, NKVFTVWGSLSFSLQLQG, (SEQIDNO:2528); XM_539558.4, C15H1orf50, Del, A_7, NLATFTTFINGRVVNSIFLLFLQRNGVQVVHMTSLVPTSYNMTCLGLHMRTLRSMM LKST, (SEQIDNO:2529); XM_014112496.1, KIAA0232, Del, A_7, NLAWRRVLRRPWILRRNQLGFCRWGSRISVWNVA, (SEQIDNO:2530); XM_014116163.1, LOC100688895, Ins, A_7, NLDYQEQLGHRLGHAGLHTDSQKPGQPLGKHH, (SEQIDNO:2531); XM_849077.4, PPAT, Del, A_7, NLEYCRTTLKAKELF1, (SEQIDNO:2532); XM_003433570.1, SLC15A5, Ins, A_7, NLGWNLLASGGDV, (SEQIDNO:2534); XM_546237.5, SH3PXD2B, Ins, A_7, NLIFQAPPGGQRATAGSK, (SEQIDNO:2535); XM_545570.5, GLS, Del, A_7, NLILEEKVVIKG, (SEQIDNO:2536); XM_005640463.2, GLS, Del, A_7, NLILEEKVVIKGIPLDHWTMKVSNKNL1, (SEQIDNO:2537); XM_534852.5, ERGIC2, Ins, A_7, NLKFGERVGCLSKGS, (SEQIDNO:2539); XM_014109749.1, ITSN1, Del, A_7, NLKLRRLSPATQLLVPSSSPWPLVS, (SEQIDNO:2540); XM_014122251.1, IP6K2, Del, A_7, NLKSCTTV, (SEQIDNO:2541); XM_014107055.1, LOC106557703, Ins, A_7, NLKSNTSLNLPQAGLDPNLHGAGSKRVGVAVFKKYEI, (SEQIDNO:2542); XM_005635468.2, NBEA, Del, A_7, NLKTLYGSTGWPWKVNLFLANCISGLTLYLATNSEDKQSVL, (SEQIDNO:2543); XM_014109621.1, ICE2, Del, A_7, NLLNEYIKNLIQLEKF, (SEQIDNO:2545); XM_014114304.1, LOC479758, Ins, A_7, NLLPEVPPH, (SEQIDNO:2546); XM_005626899.2, FKTN, Del, A_7, NLNTCFPSLHCAGLSL, (SEQIDNO:2547); XM_005617406.2, GPBP1, Ins, A_7, NLPSSSLRVSSES, (SEQIDNO:2548); XM_535836.5, KNG1, Ins, A_7, NLPYCQLSVTGKGHIDEKASRFFTFPILIH-GENRKRNN, (SEQIDNO:2549); XM_005637743.2, PLEKHS1, Del, A_7, NLQDSDKLNHTTSCQKLLKIQKKRVIISVLKVFFRSWILLLLPVILVNLLNLVVQINSL RELSIITCQ, (SEQIDNO:2551); XM_856735.5, DNM3, Del, A_7, NLQILMKFAMRLKQKQIE, (SEQIDNO:2552); XM_014114967.1, ASPM, Del, A_7, NLQLFYKH, (SEQIDNO:2553); XM_540240.5, PTPN22, Del, A_7, NLQTLFSQITPAPF, (SEQIDNO:2554); XM_536845.5, BAZ1B, Del, A_7, NLRQTTL1, (SEQIDNO:2555); XM_005634561.2, RNF13, Ins, A_7, NLSGLQAKSGSFPRRLRLRHRQQSRRK, (SEQIDNO:2556); XM_005618061.2, GIN1, Del, A_7, NLSSKKKSCFMLEKTENKIVW, (SEQIDNO:2557); XM_537353.5, CPSF2, Del, A_7, NLSSQKRQT, (SEQIDNO:2558); XM_005622961.2, PRG4, Del, A_7, NLTCSPGPLC, (SEQIDNO:2559); XM_014111941.1, PPEF1, Ins, A_7, NLTNLGRCLYLAPNWYNH, (SEQIDNO:2560); XM_014115877.1, FAM179B, Del, A_7, NLVQQDFLLQRIKTLK, (SEQIDNO:2561); XM_014120510.1, TPRKB, Del, A_7, NLVSQQKTLQF, (SEQIDNO:2562); XM_005620331.2, C5H1orf141, Del, A_7, NLWASLIKLLFKK, (SEQIDNO:2563); XM_014116360.1, LOC100685630, Ins, A_7, NLWVQRIWRSL, (SEQIDNO:2564); XM_014112221.1, FAM172A, Ins, A_7, NLYPRRIWSNSTESQ, (SEQIDNO:2565); XM_014112218.1, FAM172A, Ins, A_7, NLYPSRCH, (SEQIDNO:2566); XM_005626337.2, SEMA6A, Ins, A_7, NLYRLQRPILWVGKGSRFLCPSVTQQQIDI, (SEQIDNO:2567); XM_005627811.2, MATN2, Ins, A_7, NMCKDRLLC1A, (SEQIDNO:2568); XM_005638063.2, ZC2HC1A, Del, A_7, NMDPFARKLPLKNVRLLIQADKELKELISQQ, (SEQIDNO:2569); XM_005633672.2, USP47, Ins, A_7, NMEESWHCLFGLSYL, (SEQIDNO:2570); XM_014111472.1, CYLC1, Ins, A_7, NMESRLFSFDISQTTPAR, (SEQIDNO:2571); XM_014111164.1, MIA3, Del, A_7, NMFKKPRNKI, (SEQIDNO:2572); XM_005639118.2, RASGEF1B, Ins, A_7, NMGQSEDCKV, (SEQIDNO:2573); NM_001048138.1, IL7, Del, A_7, NMHVMIIRKVCFYIVLLTS, (SEQIDNO:2574); XM_005615937.2, CD274, Del, A_7, NMIYNLKRH, (SEQIDNO:2575); XM_005616951.1, CCDC7, Del, A_7, NMLTLQIICFL, (SEQIDNO:2576); XM_536300.5, CCNH, Del, A_7, NMSHPDLKKLL1, (SEQIDNO:2578); XM_014116352.1, EFCAB13, Ins, A_7, NMSQTLNLV, (SEQIDNO:2579); XM_005617177.2, ASB13, Ins, A_7, NMSRCFSFQH, (SEQIDNO:2580); XM_537080.5, CDC7, Del, A_7, NMSRILNYQVLKKISRSFMKLYHSMCLRLRTKLEKALLALFIWPQHSYE, (SEQIDNO:2581); XM_014109708.1, TRPM2, Del, A_7, NMSRRCQQTPLVTLFSRAWARRESTSASPRTHPPA, (SEQIDNO:2582); XM_014117695.1, FBN2, Ins, A_7, NMSSWPRIYHRWKRY, (SEQIDNO:2583); XM_005621555.2, ATF7IP2, Ins, A_7, NNACKLPEASRDPE, (SEQIDNO:2584); XM_014121817.1, LOC106560102, Ins, A_7, NNFSFASHRFP, (SEQIDNO:2587); XM_014120704.1, SYT6, Ins, A_7, NNHQEEHS, (SEQIDNO:2588); XM_014120175.1, WDR17, Ins, A_7, NNHSYLLVST, (SEQIDNO:2589); XM_014110825.1, LOC478773, Del, A_7, NNKKKLRQQLQPHLQNQESSVVLVG, (SEQIDNO:2590); XM_014120084.1, UBXN8, Del, A_7, NNKRHRVKRPADT, (SEQIDNO:2591); XM_003431743.3, DEFB112, Del, A_7, NNPEVKNTILSLIGGMHA, (SEQIDNO:2593); NM_001109813.1, ANGPTL1, Ins, A_7, NNPKEIPSCHGC, (SEQIDNO:2594); XM_005642422.1, OVCH1, Ins, A_7, NNRDNSRKQYWKTAT- PRHMWNSSC, (SEQIDNO:2595); XM_543821.5, OLR1, Ins, A_7, NNRNPYPEA, (SEQIDNO:2597); XM_014115168.1, LOC480059, Ins, A_7, NNRTEKESLW, (SEQIDNO:2598); XM_014115881.1, MIS18BP1, Ins, A_7, NNRTEMHAV, (SEQIDNO:2599); XM_005617866.2, HP1BP3, Ins, A_7, NNTFLGYPFCQPASQGPETNTDGFLPTSQDGCNPN, (SEQIDNO:2601); XM_539698.4, PTPRQ, Del, A_7, NNTYLNLEPQMLWDNLLILIILIL1R1, (SEQIDNO:2602); XM_005623466.2, LOC490717, Ins, A_7, NNVLQYAYKNCSEAS, (SEQIDNO:2603); XM_005637524.2, SLC16A12, Ins, A_7, NPAAVPCQRI, (SEQIDNO:2604); XM_005634448.1, TOPBP1, Ins, A_7, NPAKTRIRHC, (SEQIDNO:2605); NM_001205203.1, MEF2B, Ins, A_7, NPDLAHSGPKESAGDVYQAEVRADEEGL, (SEQIDNO:2606); XM_540380.5, SLC26A3, Ins, A-7, NPEAAEERPAANDTKRTHMYP, (SEQIDNO:2607); XM_014120571.1, LOC607974, Ins, A_7, NPEPVEASWHRSAFHSR, (SEQIDNO:2608); XM_014110690.1, EPHB2, Ins, A_7, NPEQYPGDAGTDEPDPVCGGL, (SEQIDNO:2609); XM_014115338.1, ASHIL, Ins, A_7, NPFKRLRGCQTPFWLRGHH1, (SEQIDNO:2610); XM_857524.4, TAOK3, Ins, A_7, NPFPRDTKWTLK, (SEQIDNO:2611); XM_014112822.1, ANK3, Ins, A_7, NPGEQAACVPGLC, (SEQIDNO:2612); XM_014115723.1, ADSSL1, Ins, A_7, NPGGRGQSSPP, (SEQIDNO:2613); XM_844262.4, DGAT2L6, Ins, A-7, NPGIKFLYLPWSGPHSRLLGLPSFQSAHYHCCWGAPANPQD, (SEQIDNO:2614); XM_547682.5, AFG3L2, Ins, A_7, NPGSAARGEEDRGIP, (SEQIDNO:2615); XM_003431543.3, ZNF354A, Ins, A_7, NPHCRKKP, (SEQIDNO:2616); XM_843509.4, TTC17, Del, A_7, NPKGIIRKLLGKR, (SEQIDNO:2618); XM_014109908.1, ANK2, Del, A_7, NPKSRTAMQASSVLPEQATWTK, (SEQIDNO:2619); XM_848173.4, ZFHX4, Del, A_7, NPLLFIPIFLLQTS, (SEQIDNO:2620); XM_014117114.1, LEMD3, Del, A_7, NPLMKHLEKYKKVRKIL, (SEQIDNO:2621); XM_539571.5, LOC482454, Del, A_7, NPLNAVTVGKPIAGRLTLQLIRKSIMERDPLCATIVGKRLRIKHNW, (SEQIDNO:2622); XM_005616128.1, LOC611492, Del, A_7, NPPDSSLLLRSPAFPFCSSSSPSSSSTYAPSMVHHHMKKPPKD, (SEQIDNO:2623); XM_542164.5, CREB3L3, Ins, A_7, NPPENQKQAVGPRKPEKEEGIY, (SEQIDNO:2625); XM_014108780.1, LOC106557931, Del, A_7, NPPERAGERASAEKARGRTLERARLDPGRRGRRRQPKMAG1, (SEQIDNO:2626); XM_005630908.2, DDC, Ins, A_7, NPPGSLSPQRQVRAALCHLRPHRGICPRAAGLEARRSAGHQPPGHPQGL, (SEQIDNO:2627); XM_014112831.1, CTNNA3, Ins, A_7, NPPSASYE, (SEQIDNO:2628); XM_014114850.1, LOC106558969, Ins, A_7, NPRFAEPPGVE, (SEQIDNO:2629); XM_014111056.1, DNAH7, Ins, A_7, NPRQFEPLPSP1, (SEQIDNO:2630); XM_014112442.1, BLM, Del, A_7, NPRRWHLIA, (SEQIDNO:2631); XM_005619526.2, TVP23B, Del, A_7, NPRSDIQWHHFSNSFESVQL, (SEQIDNO:2632); XM_849701.4, FGD6, Ins, A_7, NPSCSQRSISKHRRFFHEWLLVQIKRQ, (SEQIDNO:2633); XM_014119662.1, ZMYM1, Ins, A_7, NPSEGANCLSEERVYSAFLLHAVHQ, (SEQIDNO:2634); XM_014119514.1, ZMYM4, Ins, A_7, NPSEGANCLSEERVYSAFLLHAVPHWNSSTCPPTASSHQENLFKLLKRYFKSKGCDQ CPV, (SEQIDNO:2635); XM_014119166.1, LRGUK, Ins, A_7, NPSGKRFSGETI, (SEQIDNO:2636); XM_003640104.2, TIGD2, Del, A_7, NPVHSKELTFQTFLSLISVKKVHG, (SEQIDNO:2637); XM_005622017.2, PRKACB, Ins, A_7, NPWNRFIWKSHVGET, (SEQIDNO:2638); XM_014114190.1, ZAN, Del, A_7, NPWPPQKNTLSPVK, (SEQIDNO:2639); XM_848169.4, KIAA2026, Del, A_7, NPYLKKQSQRRGKLSQSHLLYQNFSLFALILMNSGN, (SEQIDNO:2640); XM_014118132.1, ZNF484, Ins, A_7, NPYWRETL, (SEQIDNO:2641); XM_005620231.2, INAD1, Ins, A_7, NQAKICRPSWRIAHY, (SEQIDNO:2642); XM_005621408.2, RBBP6, Ins, A_7, NQAQQRNW, (SEQIDNO:2643); XM_845288.4, ENTPD7, Ins, A_7, NQARNLCNGRHPGTCQ, (SEQIDNO:2644); XM_014111020.1, INO80D, Ins, A_7, NQASCTYQKT, (SEQIDNO:2645); XM_014113201.1, MLLT4, Del, A_7, NQASTSPATRKDQTLTWDLPGQLLAPTMPIGTREKDCLKATRQNLGALEPLKT, (SEQIDNO:2646); XM_005635161.2, STAU1, Del, A_7, NQCISLSTLTLGCSPPITTT, (SEQIDNO:2647); XM_532236.6, UFL1, Ins, A_7, NQEERKKRRG, (SEQIDNO:2648); XM_005617034.2, ARHGAP12, Ins, A_7, NQEKLKEVSYTAPHFASCS, (SEQIDNO:2649); XM_005627765.2, CAPN11, Ins, A_7, NQEMDGHLPRV, (SEQIDNO:2650); XM_534306.5, EIF2A, Ins, A_7, NQEPKEETESYRATERTSSSWKTARKKSVGENSKRESPSPGAGRFGIGYL, (SEQIDNO:2651); XM_005641892.2, SLITRK4, Ins, A_7, NQEVPDRRQPQ, (SEQIDNO:2652); XM_005629808.2, KAT6A, Del, A_7, NQFFTEEGGSENANTTIAVWSQKLFQRLQRC, (SEQIDNO:2653); XM_005639728.2, MFN1, Ins, A_7, NQGGYRRGGKQGFMCNDR, (SEQIDNO:2655); XM_535898.5, NUP153, Del, A_7, NQHSTCLPLERFPLHLGILQSLKQVSLEILLFILEKQRMVGQQLL, (SEQIDNO:2656); XM_005633958.2, DACH1, Ins, A_7, NQIGSHEQLSCQ, (SEQIDNO:2657); XM_014109582.1, RFX7, Del, A_7, NQKALQPME, (SEQIDNO:2658); XM_014117985.1, CNTLN, Del, A_7, NQLFKRRMVIYKRAHIQQFLPELTEKSGKI, (SEQIDNO:2659); NM_001003040.2, RPI, Ins, A_7, NQLLQERRPTVWRGQGGGQPAFLQDI, (SEQIDNO:2660); XM_546652.5, EPN2, Del, A_7, NQLRQWPLHHPKTMELRARTPLSASPCPLPQASPAAPGKHPSPSWAPTQPW, (SEQIDNO:2661); XM_005634045.1, GPR183, Ins, A_7, NQLYHSIFNKFGDF, (SEQIDNO:2662); XM_844389.4, DNAJC1, Del, A_7, NQNLNFLYIRL, (SEQIDNO:2663); XM_538971.3, FAM83B, Del, A_7, NQNQKWIHLLEESVLPHQILKAVFTRVRKM, (SEQIDNO:2664); XM_005637963.2, SNTG1, Ins, A_7, NQPKLSCKPADSLYGLV, (SEQIDNO:2665); XM_014110108.1, ABBBP, Del, A_7, NQPQSQARAAHPCHLDLCPHEENLYHQIMSLGSQEVQESFHQAK, (SEQIDNO:2667); XM_005628257.2, LOC482176, Ins, A_7, NQQDRNRQLYKQLLWDTKE, (SEQIDNO:2669); XM_014108499.1, KRAS, Ins, A_7, NQQRRKDSWLCEN, (SEQIDNO:2670); XM_014119368.1, LRBA, Del, A_7, NQQSYLLHLLQVYLQMLSVWFLQ, (SEQIDNO:2671); XM_005622961.2, PRG4, Del, A_7, NQRLHQLPQR, (SEQIDNO:2672); XM_005624024.1, CCDC40, Ins, A_7, NQRRAPAGSLPSGGITPPSTEPGEQQYL1R1, (SEQIDNO:2673); XM_014120511.1, KRCC1, Del, A_7, NQRRNSPSIREKKVVRNQI, (SEQIDNO:2674); XM_014120231.1, ROCK2, Ins, A_7, NQRSTDEGRRL, (SEQIDNO:2675); XM_014110645.1, ELOVL2, Ins, A_7, NQSDYFSSRVPPCLYV, (SEQIDNO:2676); XM_848511.4, ZNF653, Del, A_7, NQSGRKGGDAT, (SEQIDNO:2677); XM_005630347.2, CEBPZ, Del, A_7, NQSLLLGCTLII, (SEQIDNO:2678); XM_014106798.1, SCN11A, Ins, A_7, NQSPVSPGSVPPGFLHCYNS, (SEQIDNO:2679); XM_535949.5, KLHL41, Ins, A_7, NQSSQRRLRRQTPRT, (SEQIDNO:2680); XM_014109318.1, TRIQK, Ins, A_7, NQTYFTSNQIKSRSKENSNRHKEFAITITKHCLLFTPDC, (SEQIDNO: 2681); XM_014109320.1, TRIQK, Ins, A_7, NQTYFTSNQIKSRSKENSNRHKGSWPRTCSYIGPPTGFLCFLLSQTVHRC, (SEQIDNO:2682); XM_014111292.1, RGS2, Ins, A_7, NQVTPKAVLQSKENN, (SEQIDNO:2683); XM_848169.4, KIAA2026, Del, A_7, NRANGIIGGK1, (SEQIDNO:2684); XM_005617376.1, C2H5orf46, Ins, A_7, NRARIPQIPKPFGHRDH, (SEQIDNO:2685); XM_005626438.2, SRFBP1, Ins, A_7, NRCAKSCCQSL, (SEQIDNO:2686); XM_850281.4, POLE3, Ins, A_7, NRCRGARQGQR, (SEQIDNO:2687); XM_005633308.2, ZBED5, Ins, A_7, NRCSITIK, (SEQIDNO:2688); XM_014115260.1, AHCTF1, Ins, A_7, NRDSSPAARISFRFIFSVCLLTSCFKDQAENHI, (SEQIDNO:2689); XM_005635927.2, PER2, Ins, A_7, NREEQKTEVQTGQASRFVREHRVWGARTPPAPAAGPERHGLVTV, (SEQIDNO:2690); XM_844360.4, C16H4orf47, Ins, A_7, NREERITYTPL, (SEQIDNO:2691); XM_531825.4, C16H2orf73, Ins, A_7, NRERKLSGKQNDLTRSLPTKFPRAARD, (SEQIDNO:2692); XM_005620894.2, DYNC1LI2, Ins, A_7, NRFSWKSWCWWCAEHSQEVRTKDCVDKCSGRTG, (SEQIDNO:2693); XM_005626169.2, ETAA1, Del, A_7, NRFTPQNMRSHISLIVLLLRMKNHQQTPC, (SEQIDNO:2694); XM_014111218.1, ZC3H11A, Ins, A_7, NRGFATYSYQQRTIRGAHR, (SEQIDNO:2695); XM_014111056.1, DNAH7, Ins, A_7, NRGFLGSS, (SEQIDNO:2696); XM_014121880.1, MAP4, Ins, A_7, NRGICSGSKA, (SEQIDNO:2697); XM_005618123.2, POLR3G, Ins, A_7, NRGIGKER, (SEQIDNO:2698); XM_005616290.2, MED25, Ins, A_7, NRICVERIQPETSLRIKAQ, (SEQIDNO:2699); XM_005619375.2, OSMR, Ins, A_7, NRILPGAGSFGQPSSGHE, (SEQIDNO:2700); XM_003639317.1, LOC100856706, Ins, A_7, NRIPIKDV, (SEQIDNO:2701); XM_844590.3, DAPL1, Ins, A_7, NRIRENKYHCKCCQTPGHGYSE, (SEQIDNO:2702); XM_005623486.2, SYNE2, Del, A_7, NRISPILTIMKILSYLKKKNQLLIFQQICP, (SEQIDNO:2703); XM_540029.5, TRAPPC11, Ins, A_7, NRKCRAVF, (SEQIDNO:2704); XM_844661.3, RGS21, Ins, A_7, NRKCRKNCF, (SEQIDNO:2705); XM_005641869.2, MAP7D3, Ins, A_7, NRKEEKLVFD, (SEQIDNO:2706); XM_014112279.1, ANKRD31, Del, A_7, NRKKLPRKSKTIKTLHLCLVLV, (SEQIDNO:2707); XM_003434394.3, UBE2K, Ins, A_7, NRKPMCYGL, (SEQIDNO:2708); XM_849763.4, LOC612035, Ins, A_7, NRKTSGQGPAQEPSPPCATSFQLRQLSCPTARTVCI, (SEQIDNO:2710); XM_014118452.1, GLTSCR1L, Ins, A_7, NRMPRQSTEI, (SEQIDNO:2712); XM_014119811.1, LOC106559806, Ins, A_7, NRMYNEGWTGRAPHSGGRLRSQRSEWI, (SEQIDNO:2713); XM_014107325.1, BRCA2, Ins, A_7, NRNYKGIFGQSKKSF, (SEQIDNO:2715); XM_545545.5, PRKRA, Del, A_7, NRPRGTLLRNFLPNSVIFLQRTTF1, (SEQIDNO:2716); XM_846013.4, ERI2, Del, A_7, NRPSLFMKKNLHHLMAPQ, (SEQIDNO:2717); XM_005615470.1, PHACTR2, Ins, A_7, NRQAANLSIVLRCNHLWHV, (SEQIDNO:2718); XM_014118286.1, DHX16, Ins, A_7, NRQDTGRARI, (SEQIDNO:2719); XM_005615442.2, AHI1, Ins, A_7, NRQIWRKNCT, (SEQIDNO:2720); XM_014119347.1, NAV3, Ins, A_7, NRRCNCHF, (SEQIDNO:2721); XM_014114844.1, HFM1, Ins, A_7, NRRNRCKGT, (SEQIDNO:2722); XM_532882.5, SMC6, Del, A-7, NRRQFWTKKLID, (SEQIDNO:2723); XM_005627271.2, PNPLA1, Ins, A_7, NRRQSAVCSLSPRLHSALHFRDSLGHLQASSQPDPGTQLS, (SEQIDNO:2724); XM_005617973.2, FHAD1, Ins, A_7, NRRRDCNLEGQ, (SEQIDNO:2725); XM_005638009.2, CHD7, Del, A_7, NRRTLEKR, (SEQIDNO:2726); XM_005638435.2, DYX1C1, Ins, A_7, NRRYERKGTNKSN, (SEQIDNO:2727); XM_014107325.1, BRCA2, Ins, A_7, NRSCSCGLFVR, (SEQIDNO:2728); XM_542898.4, FERMT1, Del, A_7, NRSLSSWQPGF, (SEQIDNO:2729); XM_014112357.1, LCOR1, Ins, A_7, NRSPGCEAN, (SEQIDNO:2730); XM_005638519.2, SPG21, Ins, A_7, NRSRKLFIWPSGPYDG, (SEQIDNO:2731); XM_005640597.2, MAP2, Ins, A_7, NRSSGPLSLQEIHFKTCYQN, (SEQIDNO:2732); XM_014119970.1, GIMAP4, Ins, A_7, NRSVTRILQSRARETESADKRGVWRENQNAGG, (SEQIDNO:2733); XM_014115509.1, ACAA2, Ins, A_7, NRTESQGHGFGRGE, (SEQIDNO:2734); XM_844126.3, CD2, Del, A_7, NRTVGEMMRSWGHEHTE, (SEQIDNO:2735); XM_533254.6, HRASLS5, Ins, A_7, NRVKLNPKA, (SEQIDNO:2736); XM_543821.5, OLR1, Del, A_7, NRWNFITRT, (SEQIDNO:2737); NM_001012995.2, CAPZA2, Ins, A_7, NRWTANHYCMHREPSVPSKKLLEWSLEVRVEVYNHSFNHSSGWHLENSGS1L, (SEQIDNO:2738); XM_014107388.1, PAN3, Ins, A_7, NSALQYCNPA, (SEQIDNO:2739); XM_014112960.1, FAM35A, Ins, A_7, NSAVIQSTLFTSEG, (SEQIDNO:2740); XM_014111218.1, ZC3H11A, Ins, A_7, NSCGSCSTPF, (SEQIDNO:2741); XM_005625753.2, ATXN10, Ins, A_7, NSCLLINDFVHIPEF, (SEQIDNO:2743); XM_014117890.1, SMC2, Ins, A_7, NSCPENYRKKRG, (SEQIDNO:2744); XM_014115932.1, KIAA0586, Ins, A_7, NSCRCNSFSSC, (SEQIDNO:2745); XM_546437.4, COR8C4, Ins, A_7, NSEKNFQY, (SEQIDNO:2747); XM_532445.5, WAS1, Del, A_7, NSEKQLQTCWAGDKGNLRRGETPQMVLNPWQQLTSKIQKSQPIDFMVHKSITSPIPK KRKKEKLKRRD, (SEQIDNO:2748); XM_534816.5, CCDC65, Ins, A_7, NSETTGRHNYFKK, (SEQIDNO:2749); XM_014112808.1, SYNE1, Del, A_7, NSFMKTRVNAVDLLT, (SEQIDNO: 2750); XM_005635642.2, CEP44, Del, A_7, NSFSNVDLQNGKSKLFVIF, (SEQIDNO:2751); XM_003639706.3, RIF1, Ins, A_7, NSFYCLEESNR, (SEQIDNO:2752); XM_014107674.1, TRAF3IP1, Ins, A_7, NSGDQERL, (SEQIDNO:2753); XM_005637209.2, CIR, Ins, A_7, NSGEVLWAAGFSTGQPPRSKGIRVSREQDAADLPHRLLQRGEWHHYVPQGLPGLLP GCGPR, (SEQIDNO:2754); XM_005628783.1, LOC100856700, Ins, A_7, NSGHLLFPSNCGESLLWPKHIYLYVFHFLPQCGAGPSSFCIQQYSNTHVEPSHLQPEE QRGGGSSQEAYGEMCDIL, (SEQIDNO:2755); XM_005627588.2, CEP162, Ins, A_7, NSGSRATS, (SEQIDNO:2756); XM_014114524.1, ZNF274, Ins, A_7, NSHRREALCVSGLWESICSELLPHTASESSHWRETI, (SEQIDNO:2757); XM_003435418.3, LOC100688087, Ins, A_7, NSHRSKAI, (SEQIDNO:2758); NM_001003144.2, CHRNA1, Ins, A_7, NSHSLGKDLAPRPRSL, (SEQIDNO:2759); XM_014108601.1, SLC4A8, Ins, A_7, NSHWGRGLKCPGWRGG, (SEQIDNO:2760); XM_014113618.1, ZNF624, Ins, A_7, NSHWRKTL, (SEQIDNO:2761); XM_532318.5, TAF2, Ins, A_7, NSIDEWRRS, (SEQIDNO:2762); XM_005622341.2, RCOR3, Ins, A_7, NSIQDQLDGSPGS, (SEQIDNO:2763); XM_539002.5, COL12A1, Ins, A_7, NSIQRWQHNDGGCH, (SEQIDNO:2764); XM_005622049.2, USP33, Del, A_7, NSIRNTEVLFQT-FLMEQLLVQCSV, (SEQIDNO:2765); XM_538266.5, TBK1, Del, A_7, NSITKILSNYLLLKRRQQQDIKYLL-WNFVHVEVYILF, (SEQIDNO:2766); XM_003434950.3, C4BPA, Del, A_7, NSKCLVLERH, (SEQIDNO:2767); XM_005622027.2, IFI44, Ins, A_7, NSKGVDKVWYN-TCGVAHSCG, (SEQIDNO:2768); XM_005628995.2, ZCCHC11, Ins, A_7, NSKLFYFSGQSEY, (SEQIDNO:2769); XM_014112716.1, ZNF25, Del, A_7, NSK-LMPERKSINAMNVGSPSVRSLSS, (SEQIDNO:2770); XM_005630592.1, MBOAT2, Ins, A_7, NSKRKDYT, (SEQIDNO:2771); XM_005619062.2, ADK, Del, A_7, NSKSNIMLVALPRIQLKWHSG, (SEQIDNO:2772); XM_005629940.2, MTMR7, Ins, A_7, NSKSPVKSH, (SEQIDNO:2773); XM_014110870.1, FSIP2, Ins, A_7, NSKSSWSVRCTS, (SEQIDNO:2774); XM_014106549.1, ZBTB38, Ins, A_7, NSKWRPEA, (SEQIDNO:2775); NM_001002963.1, MET, Ins, A_7, NSLCCEIPE, (SEQIDNO:2776); XM_014107422.1, LOC606856, Del, A_7, NSLFIQFMVLEKAMEMI, (SEQIDNO:2777); XM_014115181.1, LOC106559028, Ins, A_7, NSLHRYIW, (SEQIDNO:2778); XM_543416.5, FBXO21, Ins, A_7, NSLLPTPTENFK, (SEQIDNO:2779); XM_542564.5, RCBTB2, Ins, A_7, NSLPQLWEWPPYCPCDHRRRS-LYLGS, (SEQIDNO:2780); XM_535769.5, UMPS, Del, A_7, NSMKVESSK, (SEQIDNO:2781); XM_005633789.2, LOC100856360, Ins, A_7, NSPLCPHP-SCQSLCGLPTCPQSYYLWCEDKADS, (SEQIDNO:2782); XM_014109416.1, KATNBL1, Del, A_7, NSPLEV-GAVTWQIKKMN, (SEQIDNO:2783); XM_014120611.1, AP4B1, Del, A_7, NSPMYKPMCLCK-SRDLCWLPVLQRAVSSVLLLYVMCVRSCIVCPVT-LAATTKNFFA PTRSPTISSCRRWRCCVSW, (SEQIDNO:2784); XM_003434574.3, ATP5L, Ins, A_7, NSQECSNW, (SEQIDNO:2785); XM_014115143.1, HMCN1, Ins, A_7, NSQQTSARNTYLRAAEYFWNFCPSQSRSSRASEY-LRQFS, (SEQIDNO:2786); XM_544656.5, EIF3J, Ins, A_7, NSRENKRERTATEEKARRN, (SEQIDNO:2787); XM_548436.5, ODF2, Del, A_7, NSRNHQQPTARNLI-SAE, (SEQIDNO:2788); XM_014118132.1, ZNF484, Del, A_7, NSRTMTHLEGV, (SEQIDNO:2789); XM_014109056.1, SMC3, Ins, A_7, NSRTWITSPGSI, (SEQIDNO:2790); XM_532130.5, DNAH8, Del, A_7, NSSFFLMVIVLI, (SEQIDNO:2791); XM_014121788.1, CRLF1, Del, A_7, NSSFGGLPGDLEVLAWCGGG-GAQGHSISGLTGTPL, (SEQIDNO:2792); XM_014118548.1, RGS22, Ins, A_7, NSSKPATSKSHI1, (SEQIDNO:2793); XM_535242.6, PLK2, Ins, A_7, NSSLLCRAWPVLCFPSNRCS, (SEQIDNO:2794); XM_005626026.1, LYG2, Ins, A_7, NSSPCWYLGQQRTPSAGCWDSHRQN, (SEQIDNO:2795); XM_005621631.2, TIGD7, Del, A_7, NSSRIE-SILELVVF, (SEQIDNO:2796); XM_005618818.2, SPRTN, Ins, A_7, NSSSVPYSYCQSPKCLKQLLS, (SEQIDNO:2797); XM_014121199.1, EXT2, Del, A_7, NSSVL-SAQPLMGFHLTRRTWWRGLSAST-SLLQSLEQCLLRWWSTEQTLSCTKMTFL RN, (SEQIDNO:2798); XM_534311.5, DHX36, Ins, A_7, NSS-WCSENSNCY, (SEQIDNO:2799); XM_005626267.2, ZFP62, Ins, A_7, NSSWGEAL, (SEQIDNO:2800); XM_005617173.2, FBXO18, Ins, A_7, NSTASFVPVMHKTQGSQARSG-GLSVTVFCRVWRTQPTNGGHWSRSHS, (SEQIDNO:2801); XM_005639497.2, KIAA2018, Del, A_7, NSTERK-TERHTMQWRGIERRKSMLE, (SEQIDNO:2802); XM_003434814.3, ZNF75A, Del, A_7, NSVRTPTLLNI-GEPTQVSNHILVACAEETSAGDQAFLDTRNSTA, (SEQIDNO:2803); XM_014121504.1, MGAT5, Ins, A_7, NSWAILGSLPVHAPSPGFIWYRARI, (SEQIDNO:2804); XM_014120622.1, SPAG17, Ins, A_7, NSWTSIWHSDLEGS, (SEQIDNO:2805); XM_005621999.2, SSX2IP, Ins, A_7, NSYGSFKLCGESRWKKRLLEDG, (SEQIDNO:2806); XM_014114985.1, LOC484341, Ins, A_7, NSYRGKTLWMQ, (SEQIDNO:2807); XM_014117920.1, C11H9orf84, Ins, A_7, NSYRNDDRD, (SEQIDNO:2808); XM_005635068.2, ZHX3, Ins, A_7, NSYTQGEPPQSACG, (SEQIDNO:2809); XM_014107150.1, SYCP2, Ins, A_7, NTAKQN-RESRSGSLQKRHSTATK, (SEQIDNO:2810); XM_005639670.2, CMBL, Del, A_7, NTAKWNIKLKHFLGKPMASCIGREKIVQQKTSPI, (SEQIDNO:2811); XM_005615469.2, PHACTR2, Ins, A_7, NTCASKRGCCWGKPQG, (SEQIDNO:2812); XM_005635475.2, PDS5B, Ins, A_7, NTCHRFRREIRYG, (SEQIDNO:2813); XM_014112733.1, ARID4B, Ins, A_7, NTEGAFFRL, (SEQIDNO:2814); XM_005622271.2, CAMSAP2, Ins, A_7, NTGGNGEVRCQQLFNLVPG-FRLPIQVFVYLLPRN, (SEQIDNO:2815); XM_843373.4, AGAP1, Del, A_7, NTGGRKAPA-TSKPTGSPAPLKNKKKTLSLSLCPSLARRGTLKP-PHMKSGMRGSKPSR ARS, (SEQIDNO:2816); XM_005635912.2, AGAP1, Del, A_7, NTG-GRKAPATSKPTGSPAPLKPNARLGN, (SEQIDNO:2817); XM_005619334.2, ITGA2, Ins, A_7, NTGGVNS-VCQQTKSCI, (SEQIDNO:2818); XM_536875.4, TRRAP, Ins, A_7, NTGRYLLSPLCRRAA, (SEQIDNO:2819); XM_005638476.2, VPS13C, Del, A_7, NTGSCSR-VIKVPIRSS, (SEQIDNO:2820); XM_005629477.2, LUC7L2, Ins, A_7, NTGSIGENGRYYSSTNQIQR, (SEQIDNO:2821); XM_014111169.1, LOC610561, Del, A_7, NTGVKLKSFFIRPRTSS, (SEQIDNO:2822); XM_005621522.2, NTAN1, Del, A_7, NTH-LQPVHCFLETKLCSTRRMKVAYGKRSLVQEA, (SEQIDNO:2823); XM_005639188.2, MMRN1, Del, A_7, NTNLGMKFRVVVMPWTDVSMNMP, (SEQIDNO:2824); XM_014114277.1, KPNA7, Del, A_7, NTKAPRLLNKGPNP, (SEQIDNO:2825); XM_845305.4, CCNB1, Ins, A_7, NTKASGEGT, (SEQIDNO:2826); XM_014114844.1, HFM1, Ins, A_7, NTKFFTFC, (SEQIDNO:2827); XM_014106743.1, XRN1, Ins, A_7, NTKGMRTRRNHISPPTLVFNERVY, (SEQIDNO:2828); XM_005640040.2, HIVEP1, Ins, A_7, NTKIP-TEESSSGKT, (SEQIDNO:2829); XM_534086.4, SPTY2D1, Del, A_7, NTKMKAIMPY-VTWRVVGKSSRRKKQRV, (SEQIDNO:2830); XM_005618730.2, WHAMM, Ins, A_7, NTPAVESI, (SEQIDNO:2832); XM_005623453.2, DACT1, Ins, A_7, NTPCKDQQTKNQREC, (SEQIDNO:2833); XM_014112334.1, PRC1, Ins, A_7, NTPGWQER-SQQGEPGAQWQHPERWVPRLGSPPAQLQH, (SEQIDNO:2834); XM_535304.5, CHD9, Del, A_7, NTQKMQKGNNLKKRFKVL, (SEQIDNO:2835); XM_850014.3, SLC26A2, Ins, A_7, NTQPSLSKGS-SEEGRKEKDHKGNSDSQWSPG, (SEQIDNO:2836); XM_003433632.3, TACC2, Ins, A_7, NTRETRQH-SCLAYQIPR, (SEQIDNO:2837); XM_003433617.3, USMG5, Ins, A_7, NTSCESNI, (SEQIDNO:2839); XM_014114507.1, LOC611144, Del, A_7, NTSKSME-KRNF, (SEQIDNO:2840); XM_005621538.2, ZC3H7A, Ins, A_7, NTSKTNKNK1, (SEQIDNO:2841); XM_014112460.1, AP3B2, Ins, A_7, NTSQQQKCPRGQGDLPA, (SEQIDNO:2842); XM_005641542.2, ZNF711, Del, A_7, NTSVQIVTLQL-TRK, (SEQIDNO:2843); XM_014109413.1, SLTM, Ins, A_7, NTSYCKKRRSRF, (SEQIDNO:2844); XM_003639447.3, SNX31, Ins, A_7, NTTFNKARKTLVFYQETR1, (SEQIDNO:2846); XM_532364.5, IREB2, Del, A_7, NTVPGTPETGLPKDRICWA, (SEQIDNO:2847); XM_005640003.2, PRPF4B, Del, A_7, NTVRMLVFILKL, (SEQIDNO:2848); XM_848173.4, ZFHX4, Del, A_7, NTWKQATPS, (SEQIDNO:2849); XM_543280.4, SLC16A14, Del, A_7, NTIVMVPTF, (SEQIDNO:2850); XM_014114846.1, ZNF644, Del, A_7, NTIVNTCIHHHV-LIHLVVLLDLINEKVTFSKNL, (SEQIDNO:2851); XM_014111106.1, ALS2CR11, Ins, A_7, NTYSFCK-RRWNL, (SEQIDNO:2852); XM_005637424.1, LOC102156279, Del, A_7, NVAIHVRLIVDLHS, (SEQIDNO:2853); XM_539362.3, LOC482243, Ins, A_7, NVECGICLTGTYKI, (SEQIDNO:2854); XM_535893.4, RANBP9, Ins, A_7, NVEGCIQFTRLFGSLEQPSWKSA, (SEQIDNO:2855); XM_850162.3, HCN1, Ins, A_7, NVFHSTWCCWCHHKIQ, (SEQIDNO:2856); XM_539060.3, LOC481939, Ins, A_7, NVFVVYHENHL, (SEQIDNO:2857); XM_863207.4, SNW1, Ins, A_7, NVKCIGHSGGC, (SEQIDNO:2859); XM_014115709.1, CCNK, Del, A_7, NVKISSKQLVVY, (SEQIDNO:2860); XM_005616743.2, LOC484590, Ins, A_7, NVKRLGIKMGKQGITNEGGYL, (SEQIDNO:2861); XM_538136.5, ATG4A, Ins, A_7, NVLCPPLECRHNW, (SEQIDNO:2862); XM_005639326.1, FAM47E, Del, A_7, NVLPRSTRAVIPRRLQWHIQVNGLMKKR-SQVKQICSMKMVLFFMKMEVQTSMKSS F, (SEQIDNO:2864); XM_014120322.1, KIDINS220, Ins, A_7, NVLPTIFCHLPFYLWLHYCGNYPPGYL, (SEQIDNO:2865); XM_014111009.1, TYW5, Del, A_7, NVLYYSVLEMPSNNQVLSQKSWI, (SEQIDNO:2866); XM_005628374.2, COPG2, Ins, A_7, NVPPAQLCFSL, (SEQIDNO:2867); XM_005623470.2, C8H14orf39, Ins, A_7, NVPWLYMSV, (SEQIDNO:2868); XM_014115009.1, FMN2, Del, A_7, NVQMLFSGKILR, (SEQIDNO:2869); XM_014116985.1, SETX, Del, A_7, NVRENDLRNLWLKILYGLHHLREMRTSLIFLMGEV, (SEQIDNO:2870); XM_014121449.1, RALB, Ins, A_7, NVREQRQEWQEKQQEEKF, (SEQIDNO:2871); XM_005638071.2, ZNF704, Ins, A_7, NVSSTLVFLGHG-GRCENSRHQKSPSP, (SEQIDNO:2873); XM_005618169.2, ANKRD34B, Ins, A_7, NVVKETI-IANRTN, (SEQIDNO:2875); XM_014115866.1, CTAGE5, Del, A_7, NVVTWNVKL, (SEQIDNO:2876); XM_014120092.1, TEX15, Del, A_7, NVWQRQTFRPEQCGKLNKQKKQKIHFIEKA, (SEQIDNO:2877); XM_005630011.2, WWC2, Ins, A_7, NVWRPEWL, (SEQIDNO:2878); XM_005633836.2, DZIP1, Ins, A_7, NWARTEGTSTCEE, (SEQIDNO:2879); XM_014109139.1, CFAP43, Del, A_7, NWEGTAIKKI, (SEQIDNO:2880); XM_014110047.1, BANK1, Ins, A_7, NWESIFYYKQTSCPYT-STHKYPSKRRNHTLHSSSVSTKDS, (SEQIDNO:2881); XM_005634924.1, ASXL1, Ins, A_7, NWGDAAASCPDSSEGKRGPRGIGVRSDEAQQR-GRDRF, (SEQIDNO:2882); XM_005618541.2, FAM184B, Del, A_7, NWGRSWLLPKTD, (SEQIDNO:2884); XM_014117490.1, VWA3B, Del, A_7, NWIL-SKVRKLLQDVMKMAFIFQGL, (SEQIDNO:2885); XM_846354.4, BLOC1S2, Del, A_7, NWKPSTRSWRSD, (SEQIDNO:2886); XM_005621408.2, RBBP6, Ins, A_7, NWKYRKCI, (SEQIDNO:2888); XM_005618261.2, ZNF518B, Ins, A_7, NWPPAQSARKQ, (SEQIDNO:2889); XM_005638171.2, UACA, Ins, A_7, NWRDRKRV, (SEQIDNO:2890); XM_532881.5, RAD51AP2, Ins, A_7, NWRKIEFSTIIRNRSFKQRRLSPCRCHKYM, (SEQIDNO:2891); XM_005625616.2, CCT2, Ins, A_7, NWSKSTKAN, (SEQIDNO:2892); XM_547945.4, PTPN21, Ins, A_7, NWSSQVGCPKWTLPLSTASAR, (SEQIDNO:2893); XM_014110860.1, DPP4, Del, A_7, NWTPLFCMKQNFGIR, (SEQIDNO:2894); XM_540963.4, KIAA1109, Del, A_7, NWVLHY-RMKRKRKEKTKKNT, (SEQIDNO:2895); XM_542845.5, C23H3orf33, Ins, A_7, NWVRFQFEKRKL1, (SEQIDNO:2896); XM_014110823.1, ZNF385B, Del, A_7, NYCIVHYAKWL, (SEQIDNO:2897); XM_014115338.1, ASHIL, Ins, A_7, NYKEKQWTINENNYPQNK, (SEQIDNO:2898); XM_014113297.1, GPRC6A, Ins, A_7, NYKKSTYLL1, (SEQIDNO:2899); XM_005617972.2, FHAD1, Ins, A_7, NYKPNPGTSDQDPQLSGNPAVF-YAREVAGASGREGEAE, (SEQIDNO:2900); XM_014110285.1, PARP9, Ins, A_7, NYLDTSRFSVGTGHKRI, (SEQIDNO:2901); XM_005627265.2, SRPK1, Ins, A_7, NYPASVTGS, (SEQIDNO:2902); XM_014110821.1, DYNC112, Ins, A_7, NYPRICVSLPVCCDVCYICKISSKSGCWWYIFRPN-CAVG, (SEQIDNO:2903); XM_005634064.2, CCDC168, Del, A_7, NYQEPKGYSAPSL, (SEQIDNO:2904); XM_545492.6, TBR1, Ins, A_7, NYQGDDESVRYRQFS, (SEQIDNO:2905); XM_014112279.1, ANKRD31, Ins, A_7, NYRENPK1, (SEQIDNO:2906); XM_539419.4, RBM48, Del, A_7, NYRRGRLI, (SEQIDNO:2907); XM_005615602.2, TBC1D32, Del, A_7, NYRSAG-IKSLAMEFW, (SEQIDNO:2908); XM_014111407.1, DOCK11, Del, A_7, NYSLMDVQPSRKLLPT, (SEQIDNO:2909); XM_014117827.1, C11H9orf131, Del, A_7, NYSRAPLPDPLTQVNHLAAPLP, (SEQIDNO:2910); XM_537096.5, RPF1, Ins, A_7, NYSTVHFKRFHRSDSY, (SEQIDNO:2911); XM_014111592.1, GPRASP2, Del, A_7, NYSVPKLYRYLWVSLT, (SEQIDNO:2912); XM_005615937.2, CD274, Ins, A_7, NYTICEWKGRPES-SAQQLQPEGSAIEGPALLGEGCASDHRCEIAGCR-GLLLLDRLWR C, (SEQIDNO:2913); XM_014108595.1, TULP3, Del, A_7, NYVIHHIQWQRDPILL-LARNQPQIQELLVLHPNKLITSWEKWRI, (SEQIDNO:2914); XM_003433570.1, SLC15A5, Ins, A_7, RAEQAVLHSAISHLPWHRRNESHRLPTE-CLQPSGVWIPETDVFF, (SEQIDNO:2915); XM_005639762.2, MCF2L2, Ins, A_7, RAETKGQTIRDRLFSKIGQQSVL, (SEQIDNO:2916); XM_005615473.2, ZC2HC1B, Ins, A_7, RANCNQCRGSPAAKQGSGDPKYGPS, (SEQIDNO:2917); XM_005627636.2, MDN1, Ins, A_7, RAVSCLKKPVYRNMVPTKHKS, (SEQIDNO:2918); XM_005639442.1, EPHA3, Ins, A_7, RDFGGHKNPKSGLHRKAEERLPRRSKYHGTI, (SEQIDNO:2919); XM_005635468.2, NBEA, Ins, A_7, RECEHHLWSFITDYRSKRWIGNSRDRRPFTKPEPRK, (SEQIDNO:2920); XM_005635519.2, MTIF3, Ins, A_7, REECRGART, (SEQIDNO:2921); XM_005622441.2, SWT1, Ins, A_7, REISEERHHCITQL, (SEQIDNO:2922); XM_014109202.1, CCNE2, Ins, A_7, REQICSRQTF, (SEQIDNO:2923); XM_014120723.1, SYCP1, Ins, A_7, RETNEDLRKQV, (SEQIDNO:2924); XM_855716.4, CWC27, Ins, A_7, RETRGRSKEIETQRHKKF, (SEQIDNO:2925); XM_532881.5, RAD51AP2, Ins, A_7, RFANGYSPQNM, (SEQIDNO:2926); XM_853101.4, RBM26, Ins, A_7, RGDNKGGRAREEVFQKAKS, (SE- QIDNO:2927); XM_014106573.1, MYRIP, Ins, A_7, RGRTAERDEAEAG, (SEQIDNO:2928); XM_005623593.2, MED6, Ins, A_7, RGRTYTRNGKI, (SEQIDNO:2929); XM_014109424.1, MGA, Ins, A_7, RGTETTVPITVPIISAAGLMSV, (SEQIDNO:2930); XM_546818.5, CDYL2, Ins, A_7, RIFRQAPCRR, (SEQIDNO:2931); XM_014111650.1, GPRASP1, Ins, A_7, RILDLAWRKGS, (SEQIDNO:2932); XM_014119574.1, OSBPL8, Ins, A_7, RISQGAKEKLPRRKEKSHKGVTQYNHRSFCYCYG, (SEQIDNO:2933); XM_005630347.2, CEBPZ, Ins, A_7, RKCQQKRSNI, (SEQIDNO:2934); XM_844383.3, ERMN, Ins, A_7, RKDCRTTSRRERRGGWEEQS, (SEQIDNO:2935); XM_535304.5, CHD9, Ins, A_7, RKDRESKFREWGRKLCVKFSFHILYCCIKYSCSCQPISS, (SEQIDNO:2936); XM_005622378.2, CEP350, Ins, A_7, RKDRMAGFTHWKCSELTS, (SEQIDNO:2937); XM_005615620.2, RSPO3, Ins, A_7, RKGEEKEKTQ, (SEQIDNO:2939); XM_005621973.2, CLCA4, Ins, A_7, RKGIRTIR, (SEQIDNO:2940); XM_005619255.1, FAM71B, Ins, A_7, RKKRKEGQNFQQEKFPSPQDR, (SEQIDNO:2943); XM_846524.3, ACSL3, Ins, A_7, RKQRGYNYVETNTDGSCSGNHGSDLQKCHE, (SEQIDNO:2945); XM_846664.4, SEC62, Ins, A_7, RKRERKGRKWKRRR, (SEQIDNO:2946); XM_545078.5, ZBTB11, Ins, A_7, RKSKAEPGTGV, (SEQIDNO:2947); NM_001048129.1, FGF5, Ins, A_7, RKTPCKCQVYR, (SEQIDNO:2948); XM_863229.4, TAOK1, Ins, A_7, RKTRVAFKAEGEYTAFPSRGRG, (SEQIDNO:2949); XM_005638156.1, NECAB1, Ins, A_7, RLPRGLQFGTICNSIFIEGDLESAAVSPEFSGMCHGNY, (SEQIDNO:2950); XM_014116359.1, LOC611199, Ins, A_7, RLSLEQGV, (SEQIDNO:2951); XM_005626121.2, VRK2, Ins, A_7, RLYQKLDKTQKT, (SEQIDNO:2952); XM_535743.5, CFAP44, Ins, A_7, RMGRTVQE, (SEQIDNO:2953); XM_014119796.1, KDM7A, Ins, A_7, RNGNRQTASWEDS, (SEQIDNO:2954); XM_014106344.1, PHF11, Ins, A_7, RNPQREEVDMCFL, (SEQIDNO:2955); XM_847045.4, ADAMTS20, Ins, A_7, RNQHTRSYF, (SEQIDNO:2956); XM_005639717.2, ABCC5, Ins, A_7, RNQWFTEEITRQGS, (SEQIDNO:2957); XM_535737.5, ABHDIO, Ins, A_7, RNRDERHVGHAIKVQ, (SEQIDNO:2958); XM_005624798.2, LOC491140, Ins, A_7, RNRKLCRKVANIPLL1, (SEQIDNO:2959); XM_536762.5, ATP2C2, Ins, A_7, RNSIQFRAEVDGSEMQPQE, (SEQIDNO:2960); XM_014110273.1, KIAA1407, Ins, A_7, RPGALEEIENAKQAKHPGG, (SEQIDNO:2961); XM_005627482.2, KLHL31, Ins, A_7, RPIYPKGGSQ, (SEQIDNO:2962); XM_014120520.1, BCL2L11, Ins, A_7, RPNGKATFRCKF, (SEQIDNO:2963); XM_005618779.2, RYR2, Ins, A_7, RQLPVGCTELYRREVSDVETRSRLH, (SEQIDNO:2965); XM_536302.5, RASA1, Ins, A_7, RQRKTVEKFIFYLRRQ, (SEQIDNO:2966); XM_005630977.2, DNAJC2, Ins, A_7, RRDEQNKNIS, (SEQIDNO:2967); XM_533359.5, PRPF40A, Ins, A_7, RRGGKPTSKKNLYLEYKGGSKASI, (SEQIDNO:2968); XM_005630473.2, IMMT, Ins, A_7, RRGSWGQISYNCCRGETSQHDS, (SEQIDNO:2969); XM_014109172.1, PRKDC, Ins, A_7, RRIMDSRNKRN, (SEQIDNO:2970); XM_536845.5, BAZ1B, Ins, A_7, RRKEMGSTKISASQI, (SEQIDNO:2972); XM_005631143.2, QSER1, Ins, A_7, RRKHGWFSDTTYPTNWPSQYSNP, (SEQIDNO:2973); XM_844375.4, EPRS, Ins, A_7, RRKSCRLVFSGHHKVRND, (SEQIDNO:2974); XM_535949.5, KLHL41, Ins, A_7, RRLEGSGSNENPSFHVWSGGA, (SEQIDNO:2975); XM_535898.5, NUP153, Ins, A_7, RRNACRQRRVHFRWYRTCPSAICLIVCFGKDRRETAGASHFYFSGVWEES, (SEQIDNO:2976); XM_014117069.1, GOLGA1, Ins, A_7, RRNSGENGARVGGTNQRTESHPGGVDDLQSDVIRLEPEVGRIAETLLSAGRAERSRD SFKNRCRK, (SEQIDNO:2977); XM_014122663.1, UPF2, Ins, A_7, RRQGTEEKRRRKGEGGGRIKEKRGRRKKET, (SEQIDNO:2978); XM_005620224.2, USP1, Ins, A_7, RRSKKCGRIIY, (SEQIDNO:2979); XM_014110474.1, ECT2, Ins, A_7, RRTSQIGDIGSSHGWSYSKRL, (SEQIDNO:2980); XM_014115688.1, FERMT2, Ins, A_7, RRTYWNCIQQTD, (SEQIDNO:2981); XM_014112204.1, CAST, Ins, A_7, RRYHSASSRLFETHGAQ, (SEQIDNO:2982); XM_005638009.2, CHD7, Ins, A_7, RSEGTERTQGEKRAQGTQDPESP, (SEQIDNO:2983); XM_005615489.2, SHPRH, Ins, A_7, RSFHPFHL, (SEQIDNO:2984); XM_014122295.1, LOC612320, Ins, A_7, RSFPKRSDTLPR, (SEQIDNO:2985); XM_014107158.1, BCAS1, Ins, A_7, RSGRHGIQSRKCL, (SEQIDNO:2986); NM_001003075.1, IL13RA2, Ins, A_7, RSLFSSRHIL1, (SEQIDNO:2987); XM_014120782.1, DUS4L, Ins, A_7, RSNRNASFWAAGKSLCPNGSIFKVGF, (SEQIDNO:2988); XM_014119379.1, PPFIA2, Ins, A_7, RSPCPFKNGG, (SEQIDNO:2989); XM_531734.5, GTPBP1, Ins, A_7, RSPDQARRRRPIWRASSRGAPSWRRSLLSRGCAANLVQQSPATAQAQQRGPATGGP ASQSEVPGGLRDSCQRLL, (SEQIDNO:2990); XM_005625871.2, GTPBP1, Ins, A_7, RSPDQARRRRPIWRASSRGAPSWRRSLLSRGCAANLVQQSPATAQVQGTNVQFPRW SPVPY, (SEQIDNO:2991); XM_005628564.1, LOC102157031, Ins, A_7, RSPTATTM, (SEQIDNO:2992); XM_844495.4, OCIAD1, Ins, A_7, RSQSKQIWRYLG, (SEQIDNO:2993); XM_544621.5, RMDN3, Ins, A_7, RSRDCPGEGG, (SEQIDNO:2994); XM_014108806.1, SORBS1, Ins, A_7, RSRPLPSRVRGTFRKHGDT, (SEQIDNO:2995); XM_014110297.1, POLQ, Ins, A_7, RSSEFQFRKDQYCLWILET, (SEQIDNO:2996); XM_005632611.2, KIF9, Ins, A_7, RSSERSCQ, (SEQIDNO:2997); XM_843366.4, CHD1, Ins, A_7, RSSETFWCRRVKEEKSKS, (SEQIDNO:2998); XM_005627496.2, COL21A1, Ins, A_7, RSSGDSWFNGT, (SEQIDNO:2999); XM_547299.4, CLCA1, Ins, A_7, RSSKMFSRY, (SEQIDNO:3000); XM_005635984.2, ING5, Ins, A_7, RSSSERKKGLPGSWQEDLRGRYSKEKEA, (SEQIDNO:3001); XM_014114967.1, ASPM, Ins, A_7, RSYTDHSKVLQSVSERKDGAHQLFAETGCSHSTADCFQEDESSQFIQTKQSCLCSSV LLEDETRQISISKP, (SEQIDNO:3002); XM_542340.5, AKIRIN2, Ins, A_7, RTALIYSTTGWDD1, (SEQIDNO:3003); XM_005621532.2, GSPT1, Ins, A_7, RTCKCGIHWACRCWQVNHWRTNNVFDRNG, (SEQIDNO:3004); XM_005619587.1, PATE2, Ins, A_7, RTEYVFLFQTVMCDQLRRHQLLEF, (SEQIDNO:3005); XM_537432.5, MDGA2, Ins, A_7, RTILDHTRSLSQR, (SEQIDNO:3006); XM_014119604.1, TMPO, Ins, A_7, RTLHSHVDKNFAVCCCGHFFVFGLSSYGNQPRKSVQ, (SEQIDNO:3007); XM_005626023.2, EIF5B, Ins, A_7, RTRSLCQNRTYPW, (SEQIDNO:3008); NM_001171748.1, RBM12, Ins, A_7, RVKDTCAR, (SEQIDNO:3009); XM_014114569.1, LOC489979, Ins, A_7, RVPECYYLQISFCLVPTSFPL, (SEQIDNO:3010); XM_005639981.2, RIPK1, Ins, A_7, RVSRPSPKFSCEENAVSPD, (SEQIDNO:3011); XM_014117631.1, CCDC112, Ins, A_7, RVYSELENQKAAKEGGNFQVKGKSREPISTLS, (SEQIDNO:3012); XM_014110062.1, ZGRFI, Ins, A_7, RWFDISLFRSFRKHQKQSTDISSSKVQIN, (SEQIDNO:3013); NM_001076794.1, MYH4, Ins, A_7, RWQEEGFFFPDSVSPFQGEFK, (SEQIDNO:3014); XM_014116721.1, PRR11, Ins, A_7, RWTHADNS, (SEQIDNO:3015); XM_543181.4, CENPJ, Ins, A_7, RWVHEFISSITEESDFFRNSGRKIQEKSFADTRQSISKIQAYTSS, (SEQIDNO:3016); XM_005635615.2, CLCN3, Ins, A_7, RYPPSYGPDGKPRPRFNNVQL, (SEQIDNO:3017); XM_014121014.1, AHNAK, Ins, A_7, RYQPRGSQNGHREPKNQCGRCRRKLKRSQTQDA, (SEQIDNO:3018); XM_014113440.1, EXPH5, Ins, A_7, RYRREIRKLSTVH, (SEQIDNO:3019); XM_005630575.2, ZNF638, Ins, A_7, RYRRFQRC, (SEQIDNO:3020); XM_847828.4, C9H17of78, Ins, A_7, SCRDHYHPRHIL1, (SEQIDNO:3021); XM_005615672.2, LOC483960, Ins, A_7, SCSDTWYWN, (SEQIDNO:3022); XM_005622027.2, IFI44, Ins, A_7, SDYEIRYN, (SEQIDNO:3023); XM_536747.5, HIBADH, Ins, A_7, SEERLTINRLQYY, (SEQIDNO:3024); XM_014106330.1, PIBFI, Ins, A_7, SEHLQFSGI, (SEQIDNO:3025); XM_536121.3, IARS2, Ins, A_7, SEIYSWISTECHGRNDGQTAILVYIKAKSLGCSNPCISSQDKR, (SEQIDNO:3026); XM_014113689.1, SGIP1, Ins, A_7, SFEEKQWGTKWILCGN, (SEQIDNO:3027); XM_549109.5, RPS6KA6, Ins, A_7, SFFKSSRQSSDKNGKGYTGGSKSSIYC, (SEQIDNO:3028); XM_014111818.1, LOC100683280, Ins, A_7, SFLHLFFTHACCFHYIRQLYFHLYQAFGQRRGGYQ, (SEQIDNO:3029); XM_536590.4, GUCY1A2, Ins, A_7, SFLQHWHHVPPGDKPL, (SEQIDNO:3030); XM_005627714.2, SLC16A10, Ins, A_7, SFQFCHLQGDSLCSLGSWNTTCTFWIFCALCSLDETRE, (SEQIDNO:3031); XM_005637264.2, RAD51AP1, Ins, A_7, SFSFFRGH, (SEQIDNO:3032); XM_539934.4, LMBR1, Ins, A_7, SFSMGKKFGVSCCYGSPPY, (SEQIDNO:3033); XM_014107474.1, LOC477353, Ins, A-7, SGAGTVFWFKRLK, (SEQIDNO:3034); XM_532445.5, WAS1, Ins, A_7, SGTKQSTGILLWKGCTFRPDTIGYSAEICI, (SEQIDNO:3036); XM_005641783.2, LOC102151581, Ins, A_7, SIGFPAPEACLRMQSSELGLPMV, (SEQIDNO:3037); XM_014106746.1, XRN1, Ins, A_7, SIRKRRNSSYRGQI, (SEQIDNO:3038); XM_005630575.2, ZNF638, Ins, A_7, SIRRCSTIIWACFRIQ, (SEQIDNO:3039); XM_014122439.1, DDIAS, Ins, A_7, SISFRNSWIPSDGSKEMLCCL, (SEQIDNO:3040); XM_014117106.1, LOC100685665, Ins, A_7, SKDVISWSHRGSFEIP, (SEQIDNO:3041); XM_005619838.2, CWF19L2, Ins, A_7, SKEREEKKE, (SEQIDNO:3042); XM_014115025.1, LOC100683727, Ins, A_7, SKKDDWSES, (SEQIDNO:3043); XM_005623023.2, ROCK1, Ins, A_7, SKSEFTAC, (SEQIDNO:3044); XM_843302.3, COR6C33, Ins, A_7, SLFYMLLSYDCGLTFLWKLYLYVHKSFC, (SEQIDNO:3045); XM_532655.4, NTN4, Ins, A_7, SLKIYQIENFTRKKNIVSRIMD, (SEQIDNO:3046); XM_003434058.3, LOC100684793, Ins, A_7, SLLHLWGPSLFCVFILWPPPFHVCAP, (SEQIDNO:3047); XM_844234.4, TAF1, Ins, A_7, SLSFSLRK, (SEQIDNO:3048); XM_532130.5, DNAH8, Ins, A_7, SLWECGWSAVLDTCYGNILWYQ, (SEQIDNO:3049); XM_005620578.2, ZC3H18, Ins, A_7, SNHSKRTGA, (SEQIDNO:3050); XM_005615470.1, PHACTR2, Ins, A_7, SNWVQIISFTIYFLHLISSQSFEGDTL, (SEQIDNO:3051); XM_014110190.1, SENP5, Ins, A_7, SPAKLGAGHWGPSRDP, (SEQIDNO:3052); XM_005630719.2, POLR3C, Ins, A_7, SPLCAYPT, (SEQIDNO:3053); XM_849173.4, ZIC5, Ins, A_7, SPPSEGLWV, (SEQIDNO:3054); XM_005623780.2, AK7, Ins, A_7, SQKTHDLCGCCWTSIWSRRRHLTLFF, (SEQIDNO:3055); XM_014111056.1, DNAH7, Ins, A_7, SQSKGGGFQAAHSSHSSD1, (SEQIDNO:3056); XM_014118171.1, USP45, Ins, A_7, SQSVWKRRCENELHRSDLYW, (SEQIDNO:3057); XM_005615949.1, LOC484191, Ins, A_7, SRGEERMAESTGYSL, (SEQIDNO:3058); XM_005640299.2, METIL8, Ins, A_7, SRGKLSCSSPSGRTS, (SEQIDNO:3059); XM_014110829.1, METIL8, Ins, A_7, SRGKLSCSSPSGRTSYV, (SEQIDNO:3060); XM_014107587.1, NC1, Ins, A_7, SRSCHTSQESSCHPWQKGSSYTSQKGGCTSQSSSNTWQEGNHTRQGIGSNPW, (SEQIDNO:3061); XM_540739.5, FNBP4, Ins, A_7, SRVTSLGGRRW, (SEQIDNO:3062); XM_005627018.2, TFAP2B, Ins, A_7, SSGSSQICDFSDDE, (SEQIDNO:3063); XM_536972.4, RSL1D1, Ins, A_7, SSPHPQTVAQKAQSTPVNL, (SEQIDNO:3064); XM_014108414.1, PLEKHA5, Ins, A_7, SSQFWKEI, (SEQIDNO:3065); NM_001003294.1, DLD, Ins, A_7, SSRKDGCHWCRSNRCRIGFSLAETWCRCDSS, (SEQIDNO:3066); XM_005619238.2, ZBED8, Ins, A_7, SSSFLRHH, (SEQIDNO:3067); XM_014110037.1, CDK12, Ins, A_7, STERCQKYFFI, (SEQIDNO:3068); XM_539259.4, TEC, Ins, A_7, STTSSTRNKEAKASPTNST, (SEQIDNO:3069); XM_005633756.2, HTATIP2, Ins, A_7, SWGGRICSCRSRLCLQVCGAGKSWRVQTF, (SEQIDNO:3070); XM_538283.5, PTPRB, Ins, A_7, SWPGSRSFSKEH, (SEQIDNO:3071); XM_014121223.1, CCDC73, Ins, A_7, SYLRLDKVQGHMST, (SEQIDNO:3072); XM_005620755.2, PMFBP1, Ins, A_7, TAGLPTAERARGARLRQEAGGDEQPSAAVAEAAPERPQDAGS, (SEQIDNO:3073); XM_005626092.1, LHCGR, Ins, A_7, TAIEGKNQPPGCHTDLPQPLLCF, (SEQIDNO:3074); XM_537710.5, USP32, Ins, A_7, TAKRSLWA, (SEQIDNO:3075); XM_014112716.1, ZNF25, Ins, A_7, TANSCQRENP, (SEQIDNO:3076); XM_014121788.1, CRLF1, Ins, A_7, TAPLEDCQETWRSWPGAEEAGLRATPSQA, (SEQIDNO:3077); XM_005641575.2, ARMCX2, Ins, A_7, TAQHPSAIII, (SEQIDNO:3078); XM_014111942.1, AFF2, Ins, A_7, TAQKSREEYQH, (SEQIDNO:3080); XM_014111009.1, TYW5, Ins, A_7, TCCTIQSSRCPVFIFIRY, (SEQIDNO:3082); XM_014109708.1, TRPM2, Ins, A_7, TCPGDANRRLW, (SEQIDNO:3083); XM_540240.5, PTPN22, Ins, A_7, TCRLCSVKSLQLLSEFWFCKSFFKTQRTKETTINLEYL, (SEQIDNO:3084); XM_014111164.1, MIA3, Ins, A_7, TCSRNQETKYNSV, (SEQIDNO:3085); XM_546045.5, SPZ1, Ins, A_7, TDDSGKPEL, (SEQIDNO:3086); XM_543821.5, OLR1, Ins, A_7, TDGTSSPEPESPRSSEESSKLFRSLSPGLALA, (SEQIDNO:3087); XM_014110293.1, IQCG, Ins, A_7, TDKISSKTSNCQKGTAS, (SEQIDNO:3088); XM_005615442.2, AHI1, Ins, A_7, TEEKNRQIWRKNCT, (SEQIDNO:3090); XM_005617072.1, C2H10orf67, Ins, A_7, TEGERRDY, (SEQIDNO:3091); XM_005638009.2, CHD7, Ins, A_7, TEGLWRRGRS, (SEQIDNO:3092); XM_014121289.1, ELP4, Ins, A_7, TEKHFKNRNPESWITFMGR, (SEQIDNO:3093); XM_014112279.1, ANKRD31, Ins, A_7, TEKNYRENPK1, (SEQIDNO:3094); XM_005634655.1, MED12L, Ins, A_7, TEKRTRRQEIRKY, (SEQIDNO:3095); XM_546858.5, CIRH1A, Ins, A_7, TEREPPSLHSTF1, (SEQIDNO:3096); XM_014112442.1, BLM, Ins, A_7, TESCFSGKDVSERRSGKEVSWRTDRSV, (SEQIDNO:3097); XM_014112357.1, LCOR1, Ins, A_7, TFAKSQGESKTGEY, (SEQIDNO:3098); XM_005639326.1, FAM47E, Ins, A_7, TFFPGLPGL, (SEQIDNO:3099); XM_005621512.2, SMG1, Ins, A_7, TFLNYTESPGNIA, (SEQIDNO:3100); XM_014107721.1, LOC478037, Ins, A_7, TFRQGGRFRASLGAQSN, (SEQIDNO:3101); XM_005618541.2, FAM184B, Ins, A_7, TGGEAGYCQRQTDAAGASREPEN, (SEQIDNO:3102); NM_001003154.2, TRDN, Ins, A_7, TGKERKIRGTSKVVKEGTFSSK, (SEQIDNO:3103); XM_014118141.1, PM20D2, Ins, A_7, TGNRNFRRCNVEWLFRN, (SEQIDNO:3105); XM_545951.5, RHOH, Ins, A_7, TGPGSESKGLSGVLGPQQPGGSAGV, (SEQIDNO:3106); XM_005631421.2, SPTBN2, Ins, A_7, TGRFHEHHGCQWRADPRPAGGWTPAGV, (SEQIDNO:3107); XM_846354.4, BLOC1S2, Ins, A_7, TGSQVQEAGEAM, (SEQIDNO:3108); XM_003435518.3, CLCN5, Ins, A_7, TGWGCEYFHHLFHRAFSSDATIHPTHSQASEHPGSQPLHCD, (SEQIDNO:3109); XM_014116024.1, PCNX, Ins, A_7, TGYRIRCFNDHHCWSEVATILF, (SEQIDNO:3110); XM_014114846.1, ZNF644, Ins, A_7, THGILAFIIMC, (SEQIDNO:3111); XM_014114190.1, ZAN, Ins, A_7, THGPHRKTHCPQ, (SEQIDNO:3112); XM_014109297.1, OTUD6B, Ins, A_7, TINTCNETCIRLRRTLQFCYTVGEHSY, (SEQIDNO:3113); XM_014111592.1, GPRASP2, Ins, A_7, TIQCQSSIDICGS1, (SEQIDNO:3114); XM_848511.4, ZNF653, Ins, A_7, TKAEEKEATQRELPEERGDLVRGPQAPLPIRATPGRAGPHLWPVHHSCVAVRSWPPL LPGPALTPEATQ, (SEQIDNO:3115); XM_005622961.2, PRG4, Ins, A_7, TKDYTNSPKDDYIDNAQITPYLFSGSHAPNYHQPQPKT, (SEQIDNO:3116); XM_005619458.1, EMB, Ins, A_7, TKEKGTKLRNAFKKKSMCYHTVEKHQILLLFYVRT, (SEQIDNO:3117); XM_014115747.1, LOC102156002, Ins, A_7, TKKENFNRNQPKMEFRSRKRR, (SEQIDNO:3118); XM_014120175.1, WDR17, Ins, A_7, TKMVFRMFISSRWQ, (SEQIDNO:3119); XM_005616951.1, CCDC7, Ins, A_7, TKNIQKGKKHCS, (SEQIDNO:3120); XM_005638805.2, GRIK1, Ins, A_7, TKPWCREVSLFQCHHGRTGNLTQKSEKAKEKVKN, (SEQIDNO:3121); XM_005623792.2, SETD3, Ins, A_7, TKRSVCYF, (SEQIDNO:3122); XM_014107325.1, BRCA2, Ins, A_7, TKSFRYKRKSLAYSKSPSCATFRSGR, (SEQIDNO:3123); XM_847556.4, BRIP1, Ins, A_7, TKSMSVLHSTRTNRRCSHNILSLQLSSRCTNKGKYGYQSERTGCHFRRSS, (SEQIDNO:3124); XM_848173.4, ZFHX4, Ins, A_7, TLGSRPPRAERGRTSAAVCLLARERRTVGRE, (SEQIDNO:3125); XM_014119282.1, ANKS1B, Ins, A_7, TLLLRNCKGPFSKN, (SEQIDNO:3126); XM_014108599.1, RHNO1, Ins, A_7, TLPTFPESPAAIPTRTTGGPQTPLWLSPASHHPH, (SEQIDNO:3127); XM_005639670.2, CMBL, Ins, A_7, TLQSGISN, (SEQIDNO:3128); XM_014115877.1, FAM179B, Ins, A_7, TLSNKTFFCKE, (SEQIDNO:3129); XM_005619841.2, GUCY1A2, Ins, A_7, TMAHLKSESE, (SEQIDNO:3130); XM_014108595.1, TULP3, Ins, A_7, TMSFTIFSGRETQFCF, (SEQIDNO:3131); XM_005634064.2, CCDC168, Ins, A_7, TMSKDPEITSY, (SEQIDNO:3132); XM_534105.5, MS4A14, Ins, A_7, TNPTAAVPSFAIPSFSILFCKKAPTVIT, (SEQIDNO:3133); XM_014115573.1, EPB41L3, Ins, A_7, TNSKWCLALFI, (SEQIDNO:3134); XM_005629808.2, KAT6A, Ins, A_7, TNSSPKKEGPKTQTPQ, (SEQIDNO:3135); XM_005638661.2, SCAPER, Ins, A_7, TPASCERE, (SEQIDNO:3136); XM_005635912.2, AGAP1, Ins, A_7, TPEEEKHQQLQSRRALRHR, (SEQIDNO:3137); XM_548436.5, ODF2, Ins, A_7, TPETISNQQPEIS, (SEQIDNO:3139); XM_014112646.1, PCDH7, Ins, A_7, TPGRTRSTTSQHICGSRRQHLNWIRSIL, (SEQIDNO:3140); XM_005621522.2, NTAN1, Ins, A_7, TPISNQCTVSWKQSSALQEE, (SEQIDNO:3141); XM_014109066.1, SEC31B, Ins, A_7, TPQMDEKASRCFICFWGEAGYLWPPQHPCPSGATALPPPC1-HQSSYHRI, (SEQIDNO:3142); XM_005634369.2, EFHB, Ins, A_7, TPQRRSLC, (SEQIDNO:3143); XM_005631747.1, SARTI, Ins, A_7, TPWGERGGRDDGGGQHRRRHRAAAAAP-GAQKTQAPERRWREQRWRTSEAESGA WGRARGRAAARDRSRDTQRRARAGARPG, (SEQIDNO:3144); XM_014114507.1, LOC611144, Ins, A_7, TQASLWRKETFEM, (SEQIDNO:3145); XM_005638476.2, VPS13C, Ins, A-7, TQAVAQEL, (SEQIDNO:3146); XM_014114222.1, ZCWPW1, Ins, A_7, TQGKRPSRWTRWDPAKEDTEEISGK, (SEQIDNO:3147); XM_005624991.1, MED13, Ins, A_7, TQGRRWAI, (SEQIDNO:3148); XM_538266.5, TBK1, Ins, A_7, TQSQKYCQIICY, (SEQIDNO:3150); XM_005623020.2, ESCO1, Ins, A_7, TQSRASNSLYL, (SEQIDNO:3151); XM_005619413.2, RAI14, Ins, A_7, TQSSTTSCQSYSVE, (SEQIDNO:3152); XM_536334.4, HEATR1, Ins, A_7, TRAFSSVYFSFYKWREVSVFSRF, (SEQIDNO:3153); XM_014120511.1, KRCC1, Ins, A_7, TRGGTAQA, (SEQIDNO:3155); XM_014113201.1, MLLT4, Ins, A_7, TRLLPAQPLERTKLLPGICRDSCWHPRCLSGPERKTV, (SEQIDNO:3156); XM_014109582.1, RFX7, Ins, A_7, TRRHYNQWSD, (SEQIDNO:3157); XM_005629056.2, NASP, Ins, A_7, TRRPVSGKA, (SEQIDNO:3158); XM_005635616.2, CLCN3, Ins, A_7, TRRYCGQFSCVFCTAHPVSSSRKSTATEASEHS, (SEQIDNO:3159); XM_534035.5, PRKCDBP, Ins, A_7, TRSRGRGELRRGAGGVPGPAAAAHRVAEGTEPAKGLVRPQRPGLADTHAGQAAPP WARPER, (SEQIDNO:3160); XM_014113014.1, RANBP17, Ins, A_7, TSEDRCCENAKKPHE, (SEQIDNO:3162); XM_005623724.2, KCNK10, Ins, A_7, TSEPDQDPGHLNHPVHLGRLYCICDDPRCHFQN, (SEQIDNO:3163); XM_005622961.2, PRG4, Ins, A_7, TSHVPQAPCVNSYIYPRD, (SEQIDNO:3164); XM_535898.5, NUP153, Ins, A-7, TSIQLVCLWNAFPFTIVEFFSP, (SEQIDNO:3165); XM_014110108.1, ABI3BP, Ins, A_7, TSRNPRHAPPTLAT, (SEQIDNO:3166); XM_014111457.1, LOC100686985, Ins, A_7, TSVLLKEVRGKQYLWY, (SEQIDNO:3167); XM_005615498.2, STXBP5, Ins, A_7, TTACLRVPVLFSGNQ, (SEQIDNO:3168); XM_014117827.1, C11H9orf131, Ins, A_7, TTAEPRFQIP, (SEQIDNO:3169); XM_014107475.1, LOC106557767, Ins, A_7, TTEAGPGRRFPPSTAPGPPRPSPQTPLPGSNPESRSARPG, (SEQIDNO:3170); XM_014110825.1, LOC478773, Ins, A_7, TTRRSSGSSCSRICRIKRVQWCWWDRSFLREFFSSIKVELQE, (SEQIDNO:3172); XM_539305.3, ENAM, Ins, A_7, TTTKATFKAATTYPSTARRGRPATSGIPTIWQWAISLSTATMAGSTQGTTRLWTSAS QQ, (SEQIDNO:3173); XM_005635642.2, CEP44, Ins, A_7, TVSPMWICRMENPNYL, (SEQIDNO:3174); XM_003639982.3, TNKS2, Ins, A_7, TVYCSECQLQRH, (SEQIDNO:3175); XM_005615936.2, CD274, Ins, A_7, TWENDGCGKMLHPR, (SEQIDNO:3176); XM_005638869.2, DNAJC28, Ins, A_7, TWESNDTE, (SEQIDNO:3177); XM_005634064.2, CCDC168, Ins, A_7, TWIQFKSQNATDESK, (SEQIDNO:3178); XM_539558.4, C15H1orf50, Ins, A-7, TWQHLLPL, (SEQIDNO:3179); XM_005638063.2, ZC2HC1A, Ins, A_7, TWTHLPENCH, (SEQIDNO:3180); XM_005635807.1, TRIP12, Ins, A_7, TYCEQRGAAETSGVCNAGSR, (SEQIDNO:3181); XM_005617306.2, DIAPH1, Ins, A_8, ICAKEKSKRVKGVGFKDGPESLHLSGFLSHGLSRD, (SEQIDNO:3182); XM_014119671.1, LOC106559776, Ins, A_8, ICIFTSQVKESNNNMDWS, (SEQIDNO:3183); XM_005615312.2, ZNF407, Ins, A_8, ICSGNGFP, (SEQIDNO:3184); XM_005632220.2, RAD18, Ins, A_8, IDPSERSEHFFKDQRDTFYRKDSSAFLRCSCS, (SEQIDNO:3185); NM_001005760.1, LIFR, Ins, A_8, IFNHRSHSFKGTRYLERVEF, (SEQIDNO:3186); XM_005636132.2, MPHOSPH9, Ins, A_8, IFRNSHRHPC, (SEQIDNO:3187); XM_535118.4, ATP6VOD2, Ins, A_8, IGERNSGQVPPIGPFHRNGSCQHCGDTF, (SEQIDNO:3188); XM_014120072.1, WRN, Ins, A_8, IGKNSTAAKTS, (SEQIDNO:3189); XM_005637995.1, LOC102156503, Ins, A_8, IHESKNQQETL1, (SEQIDNO:3190); XM_535949.5, KLHL41, Ins, A_8, IHRLHPKSR, (SEQIDNO:3191); XM_005618961.2, DDX50, Ins, A_8, IKASVILR, (SEQIDNO:3192); XM_014119437.1, CEP290, Ins, A_8, IKEFRRVS, (SEQIDNO:3193); XM_532929.5, FAM98A, Ins, A_8, IKGDISKSST, (SEQIDNO:3195); XM_014119919.1, NUB1, Ins, A_8, IKLGSEML, (SEQIDNO:3196); XM_005623082.2, ANKRD12, Ins, A_8, IKVGKKHKR, (SEQIDNO:3197); XM_005633985.2, MYCBP2, Ins, A_8, ILVRICSGFFII, (SEQIDNO:3198); NM_001110501.1, VEGFA, Ins, A_8, INSRKGEGAKKKAQEIPSLWALLRAEKAFVCTRSADV, (SEQIDNO:3199); NM_001003175.2, VEGFA, Ins, A_8, INSRKGEGAKKKAQEIPV, (SEQIDNO:3200); XM_546767.5, LOC489647, Ins, A_8, IPLCSFPSCCVFNWECCGGYVGDCDHSDRPE, (SEQIDNO:3201); XM_005618620.2, WDR19, Ins, A_8, IRKLPCSNRS, (SEQIDNO:3202); XM_014114844.1, HFM1, Ins, A_8, IRNRDFPF, (SEQIDNO:3203); XM_005628633.1, STK31, Ins, A_8, IRSWSACPQEPQKPHSLMGA, (SEQIDNO:3204); XM_014122790.1, NUCB2, Ins, A_8, IRTRNSSIRAWWWKIEV, (SEQIDNO:3205); XM_014113891.1, CAMTA1, Ins, A_8, ISAEPACCCADPEVLPEL, (SEQIDNO:3206); XM_535150.5, MTPAP, Ins, A_8, ISEIFIPTWTY, (SEQIDNO:3207); NM_001003212.1, F8, Ins, A_8, ISGRDRKKGKINPGECGFASGTYYDWH, (SEQIDNO:3208); XM_003639633.3, HORMAD1, Ins, A_8, ISKDGCSSCVHQSRRPSDNFRMLPV, (SEQIDNO:3209); XM_014117518.1, FOXN2, Ins, A_8, ISNCKAPIL1, (SEQIDNO:3210); XM_534048.5, DENND5A, Ins, A_8, ITFQTPEAASLRP, (SEQIDNO:3211); XM_014120114.1, SORBS2, Ins, A_8, ITNSGTLSTTQKRELL, (SEQIDNO:3213); XM_535848.5, SMC4, Ins, A_8, IWQDSRNIWQIGGFRSN, (SEQIDNO:3214); XM_852167.4, ACVR2A, Ins, A_8, KAACFKRLLAETCWDGNAL, (SEQIDNO:3215); XM_532971.5, RNF103, Ins, A_8, KAAICTTPALVK, (SEQIDNO:3217); XM_014116133.1, UNC79, Ins, A_8, KAALFKTKIS, (SEQIDNO:3218); XM_539948.5, HGSNAT, Ins, A_8, KACRAEDGPGFAAHP, (SEQIDNO:3219); XM_543550.5, LOC486424, Ins, A_8, KAEEWKFCKAQLPILLLCCWQQGPFSLCLAHVSETAFGCHP, (SEQIDNO:3220); XM_535848.5, SMC4, Ins, A_8, KAEITRRKC, (SEQIDNO:3221); XM_005619774.2, C5H11orf57, Ins, A_8, KAEKKVTQKTEEKQKRSHRYNSRFLK, (SEQIDNO:3222); XM_005632059.2, ZXDC, Ins, A_8, KAERNWEQCRSLRSRSEENERWHGQSCSLPHKPNWLVVRELSGAQWRCARTSSSSRCAVRSGPVAAG, (SEQIDNO:3223); XM_005616873.2, CD3EAP, Ins, A_8, KAGAKRTRGFEASSSRSPP, (SEQIDNO:3224); XM_014112788.1, LSM11, Ins, A_8, KAKAQSGLPAGIHSTHKSDIHSR, (SEQIDNO:3225); XM_014119014.1, TULP2, Del, A_8, KAKPPITSSLWTPQTCLGMGTTLWAKSDLMSWALSSPSLTMG, (SEQIDNO:3226); XM_005615655.2, AKAP7, Ins, A_8, KAKRLSTQLFPIHSDHQQRDYERN, (SEQIDNO:3227); XM_014121537.1, ZNF197, Del, A_8, KALFYIRGSILERISMNVKTVVRSLVLTETSLTTRDYTMGKSHMNVESVGKLSS, (SEQIDNO:3228); XM_544717.5, HERC1, Del, A_8, KALWSWLMPWQPAASPPGCPHSIGNGLLNSLCALLLRMTATIKLLPKHSPIWEEISE NAPLSSWRLIRTG, (SEQIDNO:3229); XM_014107179.1, AURKA, Ins, A_8, KAMGFGRF, (SEQIDNO:3230); XM_014112827.1, ZNF365, Ins, A_8, KANSNCEHH1, (SEQIDNO:3231); XM_005620256.1, LEXM, Ins, A_8, KAQGTDEFYELRGRT, (SEQIDNO:3233); XM_014106985.1, ZMYND8, Ins, A_8, KAQTGQPSGD, (SEQIDNO:3234); XM_014106985.1, ZMYND8, Ins, A-8, KARHQGNRKQ, (SEQIDNO:3235); XM_005616415.2, LOC102151906, Ins, A_8, KAVCEAGGVSFEEAYGKMCLEGSQYPIPRSPVRSCESWGCFGVRPRWRSGGPPKEE SHELGLGKEFCPHEKEEEGELGPCFIRPC, (SEQIDNO:3236); XM_014115507.1, PIEZO2, Ins, A_8, KAVVAALG, (SEQIDNO:3237); XM_014109240.1, STAU2, Ins, A_8, KCCGSNAVTAWL, (SEQIDNO:3238); XM_014122842.1, CCDC81, Ins, A_8, KCCLQSRSC, (SEQIDNO:3239); XM_014117230.1, C1H9orf3, Del, A_8, KCGNHFSSN, (SEQIDNO:3240); XM_014114898.1, LRRIQ3, Ins, A_8, KCGTKTNCKR, (SEQIDNO:3241); XM_533784.5, FAM208A, Ins, A_8, KCGWGLRHRRYEKQNCLEEEA, (SEQIDNO:3242); XM_003431635.3, RANBP6, Ins, A_8, KCHCYRELYFSSREDSEV, (SEQIDNO:3243); XM_005628995.2, ZCCHC11, Ins, A_8, KCINRCGI, (SEQIDNO:3244); XM_014113324.1, CCDC15, Ins, A_8, KCINVPRW, (SEQIDNO:3245); XM_014109213.1, CSPP1, Ins, A_8, KCNYGVIRNEKTAS, (SEQIDNO:3246); NM_001003176.1, RPE65, Ins, A_8, KCQKGSAA, (SEQIDNO:3247); XM_543895.5, FRMPD2, Ins, A_8, KCQWFGIQLRADEERELQSSQE, (SEQIDNO:3248); XM_014121374.1, NAA15, Ins, A_8, KCRKRKAAEKSEKEKG, (SEQIDNO:3249); XM_005620224.2, USP1, Ins, A_8, KCRSYWTSWRTKEQSRL, (SEQIDNO:3250); XM_538328.5, SMC1B, Ins, A_8, KCSCRTQTCKIRERRGRTLSESA, (SEQIDNO:3251); XM_547684.5, SPIRE1, Ins, A_8, KCSRNHPGLHQIKTPFKAGCSQKTETHSTTTTEPP, (SEQIDNO:3252); XM_005638791.2, LTN1, Ins, A_8, KCVSKAVSCGA, (SEQIDNO:3253); XM_005627838.2, UBR5, Del, A_8, KCWRKLEQKIKSPNLALVFLQCQTSLLVPRYA, (SEQIDNO:3254); XM_845089.4, CXCL13, Ins, A_8, KCYFNSTSSSAEEKNQ1, (SEQIDNO:3255); XM_005622133.1, ZRANB2, Del, A_8, KDEQDHGHPKGTTGHLLDHPILVPVQVQKRN, (SEQIDNO:3256); XM_003432196.3, MAP4K3, Del, A_8, KDLLLRSYYSILLSHN1, (SEQIDNO:3258); XM_014110862.1, PLA2R1, Del, A_8, KDLYAKWKQVFMQ, (SEQIDNO:3259); XM_014113698.1, SGIP1, Ins, A_8, KDPEDSASPHLLLLAQSPLVNSVSAAQPT, (SEQIDNO:3260); XM_014113688.1, SGIP1, Ins, A_8, KDPEDSASPHLLLLAQSPLVNSVSAQPT, (SEQIDNO:3261); XM_014113703.1, SGIP1, Ins, A_8, KDPEDSASPHLLLLAQSPLVNSVSEEKQWGTKWILCGN, (SEQIDNO:3262); XM_844389.4, DNAJC1, Ins, A_8, KDRQQECGCIKTWCFRKK, (SEQIDNO:3263); XM_005625788.2, ARFGAP3, Ins, A_8, KDRVGETWHGIWKLQKWYFTFRDFRYADHRTGNTHRSKAQKEVQ, (SEQIDNO:3264); XM_005621933.2, KIAA1107, Ins, A_8, KDSGEGSTTKDTRLQFWKVH, (SEQIDNO:3265); XM_005615983.2, PHF2, Ins, A_8, KDSQNREDAQAVQSSQVPQTPQAPEAPQTAEA-QGWRQEKREEVQGGGLAHHPQPG PAGGTH-QGGTDQN, (SEQIDNO:3266); XM_005631775.2, ZNF330, Ins, A_8, KDWCEEEGREPSGT, (SEQIDNO: 3267); XM_844219.5, RPL22, Ins, A_8, KEASSEVYP, (SEQIDNO:3269); NM_001003113.1, KCNC1, Ins, A_8, KEAYSTATAAGISQLL, (SEQIDNO:3270); XM_014114295.1, LOC106558887, Ins, A_8, KEDPHVTYIPTTQDLASTKAAEISSKERPQEKQA, (SEQIDNO:3271); XM_005621118.2, USP42, Ins, A_8, KEEEKEEALQEIRGLC, (SEQIDNO:3272); XM_848505.4, TWISTNB, Ins, A_8, KEEERPRV1, (SEQIDNO:3273); XM_014113982.1, CCDC79, Del, A_8, KEEFVKTLLKKK, (SEQIDNO:3274); XM_546032.4, CETN3, Del, A_8, KEENSLKNRNKKLKMLLN-CLTQTKMKQ, (SEQIDNO:3275); XM_005617279.2, HBEGF, Ins, A_8, KEERQRLREEERPVS-SEIQGLLHPWRMQICEGAPGSILHLPPRLPWREVP-WAEPSSRK SLNLRPYNHLGCGGCGAVICLSACHR-GASHV, (SEQIDNO:3276); XM_005618038.2, TSLP, Del, A_8, KEESQQINAGNKSHT, (SEQIDNO:3277); XM_014121882.1, MAP4, Ins, A_8, KEETKAKEIS-SSPGWGTLG, (SEQIDNO:3278); XM_531629.4, PA2G4, Ins, A_8, KEGLQDCRECHQWGNIRRE, (SEQIDNO: 3279); XM_535515.5, ZNF609, Ins, A_8, KEG-VFQGTRKSSDPWEGVSSRRRQKPIQRIIRRWDEDG-GAPEWLIRPPPKPPG, (SEQIDNO:3280); XM_535463.5, BLOC1S6, Del, A_8, KEHLNYSRR-GRKKSWKGSSNARRNLKEKSS, (SEQIDNO:3281); XM_535194.5, KIN, Ins, A_8, KEICPRRNHGD, (SEQIDNO:3282); XM_014110202.1, ABHD10, Del, A_8, KEIEMKGMWDMPSKYS, (SEQIDNO:3283); XM_848169.4, KIAA2026, Ins, A_8, KEIERCFK, (SEQIDNO:3284); XM_014106856.1, PLCB1, Del, A_8, KEIEVLKCLLSWKPKD, (SEQIDNO:3285); XM_005626884.1, CYLC2, Ins, A_8, KEIKTIPT-TRQYSFRI, (SEQIDNO:3286); XM_844090.4, INO80, Ins, A-8, KEIQGGKET, (SEQIDNO:3287); XM_014120797.1, CBLL1, Del, A_8, KEIRCVQAV-VILCSESSSVHEVLSSCVALFKGAREHTCLSETYRL-ISTTAI, (SEQIDNO:3288); XM_533327.6, DDX18, Ins, A_8, KENHNSQWRSRNTASQFRIKKKEEEKEKNGG, (SEQIDNO:3289); XM_014119005.1, MPP6, Ins, A_8, KEKDDVSHNQKCRI, (SEQIDNO:3290); XM_847157.4, PHF20, Ins, A_8, KEKEKENQT, (SEQIDNO:3291); XM_014118938.1, KRIT1, Ins, A_8, KEKESFVGN, (SEQIDNO:3292); XM_542577.3, NUFIP1, Ins, A_8, KEKKGTSFSLF1, (SEQIDNO:3293); XM_014116982.1, TTF1, Ins, A_8, KEKNFTPPGT, (SEQIDNO:3294); XM_005629478.2, LUC7L2, Del, A_8, KEKQRK-FIGILCQLPVSNNRNFESVKSALPI, (SEQIDNO:3295); XM_014117385.1, HMGXB4, Ins, A_8, KEKRGERQR-ERERRKAKKEEHVSLPG11, (SEQIDNO:3296); XM_844389.4, DNAJC1, Del, A_8, KEKRKKRQAARVWMHQNLVLQKKMKDY, (SEQIDNO:3297); XM_005640290.2, PPIG, Del, A_8, KEKRNIGKIPEN-TRKKRRSERKARKVHLVKVRLKILKHNPSLLSVQKRSL-LYLKIDS, (SEQIDNO:3298); XM_005622195.2, NAV1, Ins, A_8, KELAAKFLQQSLQHKKGTQVSFFVLRHRGD-CHTRLLRPVIPQTTARLHGDRLALHQ VLQLLLCGH, (SEQIDNO:3299); XM_014109383.1, SLC24A1, Del, A_8, KELMKVKVNSKQKTVK, (SEQIDNO:3300); XM_014114461.1, LOC612426, Del, A_8, KELQQIK-KKSVHWVHGSLM, (SEQIDNO:3301); XM_005639390.2, LOC487951, Ins, A_8, KENALHPGL, (SEQIDNO:3302); XM_014108716.1, C27H12orf40, Del, A_8, KENLKVITKRRYHRMKARNIQ, (SEQIDNO: 3303); XM_005623751.2, BTBD7, Ins, A_8, KENLWPCHPQKEVYQASKI, (SEQIDNO:3304); XM_014109043.1, CCDC186, Del, A_8, KEQKQRSSI, (SEQIDNO:3305); XM_005623762.2, DDX24, Ins, A_8, KERKKKIGAFPGYCSKGAQKSKDMDA, (SEQIDNO: 3306); XM_014115338.1, ASHIL, Ins, A_8, KERKKSSVD, (SEQIDNO:3307); XM_005623148.2, NLRP3, Ins, A_8, KERLLQEVQKTREEQIPVY, (SEQIDNO:3308); XM_005619358.2, ZNF131, Del, A_8, KER-LQKLQMLSLSHCHLQNQNLLKLR, (SEQIDNO:3309); XM_014110834.1, CWC22, Ins, A_8, KERREKKFFFRK, (SEQIDNO:3310); XM_534970.5, FRA10AC1, Del, A_8, KERTKPKKMKSHHIKNPDYLLQKRPLRKRIKG1HP-QRNQKVV, (SEQIDNO:3311); XM_005626022.2, EIF5B, Ins, A_8, KERTKRQKTKF, (SEQIDNO:3312); XM_014117434.1, IL1R1, Del, A_8, KERVQSSPCLIF, (SEQIDNO:3313); XM_014109645.1, ZWILCH, Del, A_8, KESIMIHLSMRLMFKCS, (SEQIDNO:3314); NM_001005870.1, RXFP2, Ins, A_8, KESLHIHCVDR, (SEQIDNO:3315); XM_014108751.1, TRIM23, Ins, A_8, KFCFIGAFGTTAEWTYWSMWSCRRSHWNI-WRAFSIGTRS, (SEQIDNO:3317); XM_544360.5, TRIM23, Ins, A_8, KFCFIGAFGT-TAEWTYWSMWSCRRSHWNIWREHHSLR, (SEQIDNO:3318); XM_014120122.1, SORBS2, Ins, A_8, KFDPQKTD, (SEQIDNO:3319); XM_540966.5, QRFPR, Ins, A_8, KFFICSLLLHSKRNLISST, (SEQIDNO:3320); XM_005623926.1, SERPINA14, Del, A_8, KFFPR-WASVMCLLQEQTSQASQRRISQLSLRRCMKPQWR, (SEQIDNO:3321); XM_532674.4, HCFC2, Ins, A_8, KFKTKTKSWTLCCCNWHSIVFLEWKRWLQKSTE, (SEQIDNO:3322); XM_542610.5, DIS3, Del, A_8, KFMKNSQNMPCFENTLLLLHQIMKFLLRQLN-PRIWKLKLIQPNPWLTLWTGRIPRLS HISTLS, (SEQIDNO:3324); XM_014111472.1, CYLC1, Del, A_8, KFPKGHLFT, (SEQIDNO:3325); XM_014118166.1, MMS22L, Del, A_8, KFPVQGCN, (SEQIDNO:3326); XM_541834.1, HESX1, Ins, A_8, KFQLKSPGRDRKL, (SEQIDNO:3327); XM_005635554.2, SKA3, Ins, A_8, KFSGYHENKRVFPEVWI, (SEQIDNO:3328); XM_014116745.1, HEATR6, Del, A_8, KFSMATGQPLY-LIHLSLAALSPCP, (SEQIDNO:3329); XM_535814.5, TTC14, Ins, A_8, KFTSKFTQYI, (SEQIDNO:3330); XM_536004.5, INPP1, Del, A_8, KFWEKNQMSLLTNWGKRLS, (SEQIDNO:3331); XM_014116017.1, ADAM20, Ins, A_8, KFWYKAWSCLRWRNMPSSF, (SEQIDNO:3332); XM_849638.4, LOC611915, Del, A_8, KFYKASMVMEH, (SEQIDNO:3333); XM_005624533.2, TOP2A, Ins, A_8, KGCTKRNQKGSRLKF, (SEQIDNO:3334); XM_014107459.1, CCL20, Ins, A_8, KGCVCRSKEE-MGETDCASPQP, (SEQIDNO:3335); XM_005626884.1, CYLC2, Del, A_8, KGDQNHPNYETIQFSYMMQIN, (SEQIDNO:3336); XM_005618163.2, MSH3, Ins, A_8, KGEHFHWNRGSAACHR, (SEQIDNO:3337); XM_005620248.2, C5H1orf168, Del, A_8, KGEKMLKNQKGISLEQRSKT, (SEQIDNO:3338); XM_005615362.2, LMAN1, Ins, A_8, KGGIPEGPS, (SEQIDNO:3340); XM_546411.5, SRPR, Ins, A_8, KGGQE-GEL, (SEQIDNO:3341); XM_014111745.1, CXHXorf23, Ins, A_8, KGICKHCHNNL, (SEQIDNO:3342); XM 005626849.2, TSTD2, Ins, A_8, KGICPFRQNQRNSSTFF, (SEQIDNO:3343); XM_014112635.1, LIAS, Ins, A_8, KGILTKWTRPSRFCIWRSCRQEQVG, (SEQIDNO:

3344); XM_014115338.1, ASH1L, Del, A_8, KGKEEKLG-GLKWWQEAHAGLQKG, (SEQIDNO:3345); XM_014116142.1, CLMN, Ins, A_8, KGKKEACGPRRKFSNSTRHRPILR, (SEQIDNO:3346); XM_005625956.2, APPL2, Ins, A_8, KGKREGKD, (SEQIDNO:3347); XM_014112733.1, ARID4B, Ins, A_8, KGKRQCPT1, (SEQIDNO:3348); XM_014109628.1, UNC13C, Ins, A_8, KGKSSAEKGSRFSYCWPDQNPQIF, (SEQIDNO:3349); XM_544679.5, TMOD3, Del, A_8, KGKYLSRNRNLYRRSQKKKYVLIQN, (SEQIDNO:3350); XM_005637332.2, KDM5A, Del, A_8, KGLAGRLKK, (SEQIDNO:3351); XM_005624533.2, TOP2A, Del, A_8, KGLHQKEPKRIQA, (SEQIDNO:3352); XM_014110313.1, TRIO, Ins, A_8, KGLLDARIPV, (SEQIDNO:3353); XM_014111557.1, TRPC5, Ins, A_8, KGLPRATSHQNCAKSQWHPREVKI, (SEQIDNO:3354); XM_014107179.1, AURKA, Del, A_8, KGNGLWKILKLV AHWVKESLVMFTWQGKNKASLSWLLKYYLKLNW-RKQELNIS, (SEQIDNO:3355); XM_014120784.1, PC10, Ins, A_8, KGNRYSSGDPNSYSYTAS, (SEQIDNO:3356); NM_001003306.2, ATP1A1, Ins, A_8, KGQERKGYG, (SEQIDNO:3357); XM_014119891.1, UBN2, Ins, A_8, KGRAGKQLGENRAPARAKAEGQNSGDGGATQSSVY, (SEQIDNO:3358); XM_014114461.1, LOC612426, Ins, A_8, KGRFLAAE, (SEQIDNO:3359); XM_014116686.1, LOC100686205, Ins, A_8, KGRGASVGDICGTVLCFAD-VAATICKRQHCLDGTVLPTHGSVPI, (SEQIDNO:3360); XM_005627814.2, POPI, Ins, A_8, KGRMESRSRGHVSGDSQVYHCFYFCSGPSC, (SEQIDNO:3361); XM_014107581.1, NUGGC, Del, A_8, KGRSMSLSPPLFRTTSSPVMKRQLRSLARKHVRE, (SEQIDNO:3362); XM_014107402.1, ZMYM2, Ins, A-8, KGSQEKSCIRIPVS, (SEQIDNO:3363); XM_005626885.1, LOC102156133, Ins, A_8, KGS-REENRRDKVAS, (SEQIDNO:3364); XM_014120722.1, SYCP1, Ins, A_8, KGYSRKQATEC1, (SEQIDNO:3365); XM_014112114.1, LOC102151511, Del, A_8, KHCRI-SETPQKPLNQQKAQLLQK, (SEQIDNO:3366); XM_005640182.2, PDE1A, Del, A_8, KHFAL-NYNVGVLRVSQNHSNIS-SKRKLKMNQKDCWILKMSSVTFRQTQSHQKYGT GWRPPSRGKWG, (SEQIDNO:3367); XM_543143.5, B3GLCT, Ins, A_8, KHLKASNKSHTGTP, (SEQIDNO:3368); XM_003435295.1, SLFN5, Ins, A_8, KHLPGSDLENLHEK, (SEQIDNO:3369); XM_847012.4, PDCD1LG2, Ins, A_8, KHNKKLYHRRKEGSGRSYL, (SEQIDNO:3370); XM_014119900.1, WDR60, Ins, A_8, KHQAGLCSVQ, (SEQIDNO:3371); XM_844731.4, UBE4B, Del, A_8, KHQRCAASQQSASFSATSAHSAYP-ILR, (SEQIDNO:3373); XM_014114059.1, C5AR1, Ins, A_8, KHSLDPKGYGVSPELWTPASGLHEFQH-PRVPRLWHCHPGPQHICG, (SEQIDNO:3374); XM_005628506.2, ANKIB1, Ins, A_8, KHTPTLCC-CLRDENLC, (SEQIDNO:3375); XM_847165.4, CCDC88A, Del, A_8, KHWMVLKTLLFS, (SEQIDNO:3376); XM_014121431.1, INTU, Del, A_8, KIAMTMSQCPF, (SEQIDNO:3377); XM_014110870.1, FSIP2, Del, A_8, KIANHLQRLLLEEAKLNFVRGD, (SEQIDNO:3378); XM_014120778.1, CACNA2D1, Del, A_8, KIERKILHCCGRCLAVPQA, (SEQIDNO:3379); XM_014109263.1, ST18, Del, A_8, KIESWTKLHP, (SEQIDNO:3380); XM_005628484.2, C14H7orf62, Del, A_8, KIFLTIMSKCFSQF, (SEQIDNO:3381); XM_014108759.1, ZFAND4, Del, A_8, KIFQETCH-LIMKMTLFYFQLQKNA, (SEQIDNO:3382); XM_014112381.1, LINS1, Del, A_8, KIFSPIMPQHF, (SEQIDNO:3383); XM_540966.5, QRFPR, Del, A_8, KIFYLQFVIA, (SEQIDNO:3384); XM_005619248.2, CLINT1, Del, A_8, KIGEEFTSHCCF, (SEQIDNO:3385); XM_014121533.1, TAMM41, Del, A_8, KIGTITLS, (SEQIDNO:3386); XM_005628375.2, CEP41, Del, A_8, KIID-TERMSSSRD, (SEQIDNO:3387); XM_014107151.1, SYCP2, Del, A_8, KIIKISQIQNQRMNKNFHFRLKRNC, (SEQIDNO:3388); XM_005626702.1, TOPORS, Del, A_8, KIITVKGSITTMKGTDQEACPVIDQKLHLQGLTG, (SEQIDNO:3389); XM_532307.5, NUDCD1, Del, A_8, KIKIIKNTKLLSVIFSVGSQCHIMLL, (SEQIDNO:3390); XM_005626023.2, EIF5B, Del, A_8, KIK-KISQVLMWRVGMKMMIPPSK-LRRWPKRRQKRKSVKEKREMKKKQNYGS, (SEQIDNO:3391); XM_014117392.1, KIAA1033, Del, A_8, KIKLELLSLMMGLPWVWLTF, (SEQIDNO:3392); XM_014109972.1, C32H4orf36, Del, A_8, KIKPLRMFASLLQNPSNLKGSMK, (SEQIDNO:3393); XM_005637551.2, HELLS, Del, A_8, KIKRRMRK-KAPLLISV, (SEQIDNO:3394); XM_545015.5, TBCK, Del, A_8, KIKSGKKRGLTF11, (SEQIDNO:3395); XM_014115144.1, C7H1orf27, Del, A_8, KILKKSFTSSLTEFLSPFRDL1, (SEQIDNO:3396); XM_014115932.1, KIAA0586, Del, A-8, KILLSLLY-RYCPMWILIAFQMVVLMLNLCLVPKKNLLL, (SEQIDNO:3397); XM_544360.5, TRIM23, Del, A_8, KILLY-WSFWNDCRMDILVNVELQKKPLEYLERASFVAMK-MKLTLRLYIALYVQLIC AQSVLKLLILQRH, (SEQIDNO:3398); XM_014108751.1, TRIM23, Del, A_8, KILLYWSFWNDCRMDILVNVELQKKPLEYLE-SIQYWNQKLTRSEHQF, (SEQIDNO:3399); XM_536500.4, NUP155, Del, A_8, KILRVLGFISIN-MENQKKTSWDCRLSKKD, (SEQIDNO:3400); XM_849421.4, YY1, Del, A_8, KILTMRQWLKSRSLERTPLLIIQST, (SEQIDNO:3401); XM_544974.4, PKD2, Del, A_8, KILWMTFLRV, (SEQIDNO:3402); XM_014122434.1, TMEM236, Del, A_8, KIMVLRLPYLKHYLTCQFLWF, (SEQIDNO:3403); XM_005639749.2, FXR1, Del, A_8, KIPSLNAQWMFLRI, (SEQIDNO:3405); XM_532674.4, HCFC2, Del, A_8, KIQDQDQELDTVLLQLALDCIFGVEEMATKKH, (SEQIDNO:3407); XM_014120122.1, SORBS2, Del, A_8, KIRPPKNRLRRQNVKHPCLRP, (SEQIDNO:3408); XM_005617578.1, HEATR3, Del, A_8, KIRTEILLRT, (SEQIDNO:3409); XM_014118268.1, LAMA4, Del, A_8, KIS-NWSRRKLWELVMDAQKTLLYLAE-HISMDRVSLLQFRKCLSSMALKEVLISERYS QMGCYSIMLQGLTCSPFLWITARWSWT, (SEQIDNO:3410); XM_005628995.2, ZCCHC11, Del, A_8, KISK-MIFV, (SEQIDNO:3411); XM_005637237.2, CHD4, Del, A_8, KISNNVSC-SILQMVVLLSCTPFGRMRSGQPQSLRRLTRF-GIGGTTTGCWLAS, (SEQIDNO:3412); XM_541834.1, HESX1, Del, A_8, KISTQISWKR, (SEQIDNO:3414); XM_005634301.2, NKTR, Del, A_8, KITLQVRGTAAALKRDFTINM, (SEQIDNO:3416); XM_014113449.1, CUL5, Del, A_8, KITVVENYIGIIS-CQMEL, (SEQIDNO:3417); XM_014109514.1, MTFMT, Del, A-8, KIVAMQQCI, (SEQIDNO:3418); XM_014120568.1, CD58, Del, A_8, KIWIKSLNGKNT-MAAELSHL1, (SEQIDNO:3419); XM_005623463.2, LOC490717, Del, A_8, KIWNGNLLSSRDLAKGTMIDPI-TIK, (SEQIDNO:3420); XM_535814.5, TTC14, Del, A_8, KNLKNSIYLIR, (SEQIDNO:3421); XM_005619358.2, ZNF131, Ins, A_8, KKDCRNFKCYH, (SEQIDNO:3422); XM_003639706.3, RIF1, Del, A_8, KKDVRKKKRP-FRKVHCM, (SEQIDNO:3423); XM_014117434.1, IL1R1, Ins, A_8, KKEYNHHHA, (SEQIDNO:3424); XM_546524.5, DLAT, Del, A_8, KKGKKSMRVN, (SE- QIDNO:3425); XM_534970.5, FRA10AC1, Ins, A_8, KKGQNQKR, (SEQIDNO:3426); XM_005638329.2, ADAL, Del, A_8, KKHKYFWICFLTELGMGHFSAP-LRKDPLSW, (SEQIDNO:3427); XM_005620105.2, NCOR1, Del, A_8, KKKKRKMKKKKMKRRTLKRT-PRKRTRRKVQQKKRKRENRPRPGDERPPTVRAAE RAGSPGP, (SEQIDNO:3428); XM_014118133.1, ZNF292, Del, A_8, KKKMKWMS, (SEQIDNO:3429); XM_014118082.1, DST, Del, A_8, KKLCLLVKNRWML-SKSLLSH, (SEQIDNO:3431); XM_014112817.1, FAM13C, Del, A_8, KKLNNQPYPCPIYMR-PLCLYFLTISEKLGLTRRDFGKP, (SEQIDNO:3432); XM_005615829.2, CEP78, Del, A_8, KKMNCLE-IADLLQRK, (SEQIDNO:3433); XM_014115201.1, KIFAP3, Del, A_8, KKNQASLKIHLLLKEWRLMKLLTLMTWMINTL-SYYMKIFLTKFGVLL, (SEQIDNO:3434); XM_005628212.2, LOC475149, Del, A_8, KKPNKNTQITFSLTSFTL, (SEQIDNO:3435); XM_005620231.2, INAD1, Del, A_8, KKRDKELLHLQ, (SEQIDNO:3436); XM_014120622.1, SPAG17, Del, A_8, KKRIILQKM, (SEQIDNO:3437); XM_005623419.2, WDHD1, Del, A_8, KKRKISEKS, (SEQIDNO:3438); XM_005634532.2, TFDP2, Del, A_8, KKSSGLA-CLPILLRNVKILR, (SEQIDNO:3439); XM_014112829.1, JMJD1C, Del, A_8, KKTKNLPLKSKLKKRENKTILILQI-AEHHLLHPRIMNRVQLYEIC, (SEQIDNO:3440); NM_001003212.1, F8, Del, A_8, KKTLCHYVQKIQNHP-PRYRSCQIG, (SEQIDNO:3441); XM_844150.4, FAM155B, Ins, A_8, KLAQRPLSELHSLLLRHLHGLG-LAAGHGPPRQPGLQPGHPAGGPAGCSGQPGLRGL GGL, (SEQIDNO:3443); XM_548323.4, CLUH, Ins, A_8, KLCCATEEKGPAPPIREDCHPVPGVQLDSPPGGACH-GLCACGGCLHLEAG1, (SEQIDNO:3444); XM_005626458.2, CSNKIG3, Del, A_8, KLDVAILENYD, (SEQIDNO:3445); XM_535467.5, SLC12A1, Ins, A_8, KLEESSLDRD, (SEQIDNO:3446); XM_005617468.2, BDP1, Del, A_8, KLEETTLPERRYQK, (SEQIDNO:3447); XM_005619248.2, CLINT1, Ins, A_8, KLEKSLQVI-AASSLPHKEWIRACCYKCQRTHL, (SEQIDNO:3448); XM_014121533.1, TAMM41, Ins, A_8, KLEPLL-FPESFGAQDYHHCPE, (SEQIDNO:3449); XM_545208.5, PIK3CA, Del, A_8, KLEVCCYHLNN, (SEQIDNO:3450); XM_005625593.2, HE1B, Ins, A_8, KLGQERSMEVFFGESSGCG, (SEQIDNO:3451); XM_545493.4, IFIH1, Del, A_8, KLHEKEIEKTVFVQSI, (SEQIDNO:3452); NM_001197076.1, ASPM, Ins, A_8, KLHKLQGFGYHNSKMVSRY, (SEQIDNO:3453); XM_014111710.1, BRWD3, Ins, A_8, KLHPRSSNPQLE, (SEQIDNO:3454); XM_535265.5, RAD17, Del, A_8, KLIRFLKTKKSKLL-VAKMFLSFSSEHWGKYYIVKEHL, (SEQIDNO:3456); XM_005623158.1, TRIPI 1, Del, A_8, KLKNLRIK, (SEQIDNO:3457); XM_005621973.2, CLCA4, Del, A_8, KLKQQDVPQVLLD, (SEQIDNO:3458); XM_005635545.2, SACS, Del, A_8, KLKTYRSV-LAQTRTFF, (SEQIDNO:3459); XM_014111654.1, LOC106558442, Del, A_8, KLLEHPLLP, (SEQIDNO:3460); XM_014109514.1, MTFMT, Ins, A_8, KLLLCN-SAL, (SEQIDNO:3461); XM_532916.5, SLC4A1AP, Del, A_8, KLLVQANFQQHFPP-NIQKMTQTTVCGSHLKAKVEMAGPI, (SEQIDNO:3462); XM_014120253.1, SLC4A1AP, Del, A_8, KLL-VQANFQQHFPPNIQKMTQTTVCGSHLKVGQVGTP-WFF, (SEQIDNO:3463); XM_014120252.1, SLC4A1AP, Del, A_8, KLLVQANFQQHFPP-NIQKMTQTTVCGSHLKVVISAS, (SEQIDNO:3464); XM_005630696.2, LOC608067, Ins, A_8, KLPLHVWLGPSIL, (SEQIDNO:3465); XM_005621465.2, ACSM3, Del, A_8, KLQHLTNIPER, (SEQIDNO:3466); XM_534728.4, THOC5, Del, A_8, KLQIQPISISLIKLAS, (SEQIDNO:3467); XM_541402.3, LOC484287, Del, A_8, KLRKSCIG, (SEQIDNO:3468); XM_014119702.1, CFAP54, Del, A_8, KLRLKWILHGFFYCATIFICKGLII, (SEQIDNO:3469); XM_014114998.1, TOR1AP1, Del, A_8, KLRNGLNQPQE, (SEQIDNO:3470); XM_005630347.2, CEBPZ, Del, A_8, KLRQKKLCLTVPV1, (SEQIDNO:3471); XM_005623463.2, LOC490717, Ins, A_8, KLRRI-SIVPGFEI, (SEQIDNO:3472); XM_014116753.1, LIG3, Del, A_8, KLRTSQSWKAGKSWKIMRRNR, (SEQIDNO:3473); XM_014108490.1, GPR19, Ins, A_8, KLRWHFRN-SSHGQNYNQRID1, (SEQIDNO:3474); XM_849218.4, LOC611538, Ins, A_8, KLSKNRKHN1, (SEQIDNO:3475); XM_543181.4, CENPJ, Del, A_8, KLS-LIIEKMYPSVQNMLVAKSGIRHKVKTNFL-FRQDWSAACLLVAPKMRP, (SEQIDNO:3477); XM_005638394.2, CEP152, Del, A_8, KLSVICFV-IFKRVRKELQKW, (SEQIDNO:3478); XM_005638476.2, VPS13C, Del, A_8, KLVCDALSSVTL, (SEQIDNO:3479); XM_014111157.1, COPA, Ins, A_8, KLVPWCSGVR-RERNNWG, (SEQIDNO:3480); XM_543181.4, CENPJ, Del, A_8, KLVVLQKWLILKKDLLKLQSEKGNRHLKTT, (SEQIDNO:3481); XM_539294.3, LOC482175, Del, A_8, KMANTTAGHL, (SEQIDNO:3482); XM_532580.5, EPS15, Del, A_8, KMCLRKYRSKVKMYPQHCHQR-LELQQDPVHHHLGKDPSTNWILLILLN, (SEQIDNO:3483); XM_005630332.2, FEZ2, Del, A_8, KMDHHLLKIFKY, (SEQIDNO:3484); XM_005636122.2, SBNO1, Del, A_8, KMEDMIWEF, (SEQIDNO:3485); XM_545754.6, ATP1A4, Del, A_8, KMGPTPSPRPPQPRSGSSSVASCSGASPSCCGSGPS-SASWPTASRCTTRRTRPRTTCT WAWSWLLWS, (SEQIDNO:3486); XM_014113324.1, CCDC15, Del, A_8, KMHQCSQMVEGKPFPLKRNLTLRNLHLLR, (SEQIDNO:3487); XM_014113138.1, C4H5orf42, Del, A_8, KMIHCSVVSRREDWNLHLCLTQYMQKIM-SRKQIKPLQNCILSRKISLQHGL, (SEQIDNO:3488); XM_014109179.1, ATP8B1, Del, A_8, KMILFQLTSCYC-PALSLTASAMSKQLNWMEKPI, (SEQIDNO:3489); XM_537881.5, OSBPL1A, Del, A_8, KMIRKILKRRK-TANR, (SEQIDNO:3490); XM_005620587.1, ZCCHC14, Del, A_8, KMKDMLNVPLRSCGLILQ, (SEQIDNO:3491); XM_014113954.1, ZCCHC14, Del, A_8, KMKDMLNVPLSYPSCTLKKIWRSSFIA, (SEQIDNO:3492); XM_535952.5, SSB, Del, A_8, KMKKESKIK, (SEQIDNO:3493); XM_014107377.1, NBEA, Del, A_8, KMKKRIMVH, (SEQIDNO:3494); XM_535743.5, CFAP44, Del, A_8, KMKLPSSRTKKKHSMLV-SKQPLEKTINLLISS, (SEQIDNO:3495); XM_857314.4, PHF20L1, Del, A_8, KMKLTLAVLPTLRNLHCY-PQLCLQGRLAARNANMNLEILLGV, (SEQIDNO:3496); XM_843419.4, MICU3, Del, A_8, KMKREKQKEMK-KNVQCCVFNFMDTILLLIVYLKQMLRNLSPEAIGIH, (SEQIDNO:3497); XM_005625970.1, SH3RF3, Del, A_8, KMKRKRRRVGC, (SEQIDNO:3498); XM_540106.4, UBXN2A, Del, A_8, KMKYVCPRSLCSSPSQGKVTDW-EVPHQKLFLSQRVLKLRIKHCLLFN, (SEQIDNO:3499); XM_536785.5, WDR59, Del, A_8, KMLIAS-PPVTTGMCGYGTSGNPVQQWNISQLTSLKSMAWP-GTQMLSTFLLLPVKTT LSSSGITASLGNTSAFSLAR-CLSGRPDTLLSATAW, (SEQIDNO:3500); XM_014117718.1, VDAC1, Del, A_8, KMLKSRQGIS-GSTSTWAVMWILTLL- VLPSGVLWCWAMRAGWLATR. (SEQIDNO:3501); XM_845089.4, CXCL13, Del, A_8, KMLLQLNQLQC, (SEQIDNO:3502); XM_005637095.1, PLCZ1, Del, A_8, KMLLVQNGMKHSHLLFMCQNWR, (SEQIDNO:3503); XM_014122842.1, CCDC81, Del, A_8, KMLPTISELLKL, (SEQIDNO:3504); XM_014109240.1, STAU2, Del, A_8, KMLRKQCCYSMKHPLVFKINL-TRQGKTKDGVVQRLGFLNQQITLQKEFFICLLMFIK RWKPAATK, (SEQIDNO:3505); XM_005635554.2, SKA3, Del, A_8, KMMPTLQILPWHLHSALLV, (SEQIDNO:3506); NM_001145981.1, MPHOSPH8, Del, A_8, KMNPKRKTRKGMIWTRKKKAV, (SEQIDNO:3507); XM-850195.4, C4H5orf34, Del, A_8, KMNSHL-TIVNQNLQRPCWKKLMKREYQWH, (SEQIDNO:3508); NM_001003176.1, RPE65, Del, A_8, KMPER-LRSLKLGDTCFL, (SEQIDNO:3509); XM_014112356.1, CCDC28A, Del, A_8, KMPFQLVKAQGFQILHHSQLHNDQS, (SEQIDNO:3510); XM_543895.5, FRMPD2, Del, A_8, KMPVVWD-SASCR, (SEQIDNO:3511); XM_014121374.1, NAA15, Del, A_8, KMQKKKSSREIRKRKRMMMMKKSEVQK-KNLSLRNWPRLKLHWKKLLNF, (SEQIDNO:3512); XM_005631921.2, NCKAP5, Del, A_8, KMQKVW-GLETNN, (SEQIDNO:3513); XM_014114898.1, LRRIQ3, Del, A_8, KMRHKNELQKIMRQFRMVYNNVGRTDMII, (SEQIDNO:3514); XM_005619180.2, EIF4E1B, Del, A_8, KMRKKGQRG1, (SEQIDNO:3515); XM_014118874.1, ABCB1, Del, A_8, KMRRKKRNQLSARLQCFAIQI-GLIGCICWWGQWLPSSMELHSLS, (SEQIDNO:3516); XM_005616743.2, LOC484590, Del, A_8, KMRRSVVVKRNF, (SEQIDNO:3517); XM_014106743.1, XRN1, Del, A_8, KMRRYLDI-LRKLEVSGCIHLQQSSFLQST, (SEQIDNO:3518); XM_014112364.1, FAN1, Del, A_8, KMSITPLFLFLTMHHLLNLPALFVVKWCQGMT, (SEQIDNO:3519); XM_003431635.3, RANBP6, Del, A_8, KMSLLQRTVFQQ, (SEQIDNO:3520); XM_005623082.2, ANKRD12, Del, A_8, KMTIERKVEKRWIENMTK-KNLKKTGI, (SEQIDNO:3521); XM_014122254.1, ALAS1, Del, A_8, KMTIPIEFLKL, (SEQIDNO:3522); XM_005638152.1, TMEM70, Del, A_8, KMTLRRIRG, (SEQIDNO:3523); XM_005638777.2, LOC100683655, Del, A_8, KMTRCKRKS, (SEQIDNO:3524); XM_003433969.2, LOC100683655, Del, A_8, KMTSRCK-RKS, (SEQIDNO:3525); XM_005616941.2, CUL2, Del, A_8, KMTWQICMSYFVLCPLVYLI, (SEQIDNO:3526); XM_539781.2, ASIC5, Del, A_8, KMVFTSTIELCWNVT-FLESHVVHRTSHMYSLNMEIVLLLIMVKIFQRKK, (SEQIDNO:3527); XM_005624049.2, TNRC6C, Del, A_8, KMVLDGMLT-VIGQGLVGMMPPGLGPVAGVMAQMQR, (SEQIDNO:3528); XM_003433570.1, SLC15A5, Del, A_8, KMV-VATVSSMWKTQNISSPFFLSSFSSSSTKYALCRFLQDIM-CRP, (SEQIDNO:3529); XM_532052.5, MED23, Del, A_8, KMWRRNIGSGSQ, (SEQIDNO:3530); XM_533784.5, FAM208A, Del, A_8, KMWVGTQTQKI, (SEQIDNO:3531); XM_014110001.1, SMARCAD1, Del, A_8, KMYLILKELLKTLNMIRALMWVVH, (SEQIDNO:3532); XM_547682.5, AFG3L2, Del, A_8, KNQSQLL-PRALLEEELVAVENEVARKM-ILTGGPDSRRVTFHGMTRNSGCTFSGLLYF GVESCFTSCSRALGEKSRGRTLSITIFPKE, (SEQIDNO:3533); XM_531808.5, RHOQ, Ins, A_8, KNRIEMYKLL-FDYV, (SEQIDNO:3534); XM_014109043.1, CCDC186, Ins, A_8, KNRNREAAYEHN, (SEQIDNO:3535); XM_005633300.2, MS4A1, Del, A_8, KNSRLKQQKKWLS, (SEQIDNO:3536); XM_005638363.2, SPG11, Del, A_8, KNYMKLTLGLNFWFSVDRFPVI, (SEQIDNO:3537); XM_005631997.2, PRPF40A, Del, A_8, KPILGIQRRKQSKHLKNY, (SEQIDNO:3538); XM_005624343.2, GJC1, Del, A_8, KPKWGPKLGP-TRAVLVANQEMGRPPSGF, (SEQIDNO:3539); XM_005623009.2, RBBP8, Ins, A_8, KPPEN-STLQQHFYF, (SEQIDNO:3540); XM_005633761.2, MUC15, Del, A_8, KPQHKALQQV, (SEQIDNO:3541); XM_005637544.2, MYOF, Ins, A_8, KPSGSFCRSFLCWKKGLHKYN, (SEQIDNO:3543); NM_001197044.1, CYP2C18, Del, A_8, KPTHLPVILLSF-WAVLPAM, (SEQIDNO:3544); NM_001003252.1, CD4, Ins, A_8, KPVGPRILSSGHQGSRSC, (SEQIDNO:3545); XM_014121537.1, ZNF197, Ins, A_8, KPYFTSEVPYWRESL, (SEQIDNO:3546); XM_845607.3, EAF2, Del, A_8, KQDLKEVVKFSIA, (SEQIDNO:3547); XM_014115839.1, BAZ1A, Del, A_8, KQDRIFRVFQNH, (SEQIDNO:3548); XM_005623463.2, LOC490717, Ins, A_8, KQECRHSDK, (SEQIDNO:3549); XM_535077.4, TGS1, Ins, A_8, KQEQKGNWSAS, (SEQIDNO:3550); XM_014118258.1, OGFRL1, Del, A_8, KQHQEDLERKQTVLAQSPAVKLPSQET-PRTVMLKIQILNWKKQSPIPQRGRRLQLLL KKMKKVKIIRKTVKILELQVPMMMYNYS, (SEQIDNO:3553); XM_538754.4, MURC, Ins, A_8, KQIPCGDLPGGDSVSNIPVYCQGQKPN, (SEQIDNO:3554); XM_014120622.1, SPAG17, Del, A_8, KQKRKVRKLVKRKERKR, (SEQIDNO:3555); XM_014119014.1, TULP2, Ins, A_8, KQNLQL-PHLSGPHRPVSGWEQLCGQSQI, (SEQIDNO:3556); XM_544914.5, TRAPPC10, Ins, A_8, KQNQHPSPNFYCGQNKE, (SEQIDNO:3557); XM_005641832.2, USP26, Del, A_8, KQNSKKQLNGDSSMKQ, (SEQIDNO:3558); XM_014120068.1, RAB11FIP1, Del, A_8, KQQQRAP-LIKWKILARGSRFFRPGSHPQRHSQSQLSQAR-ERGQPSTDFIP, (SEQIDNO:3559); XM_005641516.2, ATRX, Del, A_8, KQRNLQVRDAF, (SEQIDNO:3560); XM_014120308.1, FAM228B, Del, A_8, KQSFTKTKDHPFWKKNLYVFMRERRKRPILKVT-SLTLSRR, (SEQIDNO:3561); XM_014120309.1, FAM228B, Del, A_8, KQSFTSSLP, (SEQIDNO:3562); XM_005635835.2, SP100, Ins, A_8, KQSSKSEKERQT, (SEQIDNO:3563); XM_014118899.1, CASD1, Del, A_8, KQTEIVSGILAYC, (SEQIDNO:3564); XM_005617175.2, FAM208B, Del, A_8, KQVITLRKNFKRLSGFFCLKLKIRQS, (SEQIDNO:3565); XM_853584.4, TGFB2, Ins, A_8, KQWEDPT-SPANVVALLQT, (SEQIDNO:3566); XM_005635698.2, ADAM28, Ins, A_8, KQWSPCSWLHGNTL, (SEQIDNO:3567); XM_005622195.2, NAV1, Del, A_8, KRAGCEVP-STKPSA, (SEQIDNO:3568); XM_014110313.1, TRIO, Del, A_8, KRASRCQDSCLRTVSR, (SEQIDNO:3571); XM_014112562.1, FAM193A, Ins, A_8, KRCKKEMLVQFPRCFYGSEQSCDGHV-ISHLLCVLHSHYGAV, (SEQIDNO:3572); XM_846902.4, ZMYM5, Del, A-8, KRDYQNKKKRLQSYRFWQNVQIPY, (SEQIDNO:3573); XM_005627814.2, POP1, Del, A_8, KREDGKQVPRARLRRFPSISLLLLLLRPELLKSVLC, (SEQIDNO:3574); XM_014110834.1, CWC22, Del, A_8, KREEREEILFPKMSTDSEIRTVKML, (SEQIDNO:3575); XM_014112733.1, ARID4B, Del, A_8, KREKAVPHT, (SEQIDNO:3577); XM_014116982.1, TTF1, Del, A_8, KREKFHTTRNLRHWLGLVVSRMCTPKDGKGSV-KLGPQKNGKGSVKLGLLVE, (SEQIDNO:3578);

XM_005623751.2, BTBD7, Del, A_8, KREPLA-LPPSKRSLSSVENLIGLPIMPSRCENSSLGGM-LEMLML, (SEQIDNO:3579); XM_014107402.1, ZMYM2, Del, A_8, KREPREKLYQDTSLMMIVL-TIQNVPFLSNIRMV, (SEQIDNO:3580); XM_014118938.1, KRIT1, Del, A_8, KRERKFCWKLNFKATVK, (SEQIDNO:3581); XM_005636747.2, CBX5, Del, A_8, KRESRAMISLGAL-REDWNQKRSLGRQIPVVI, (SEQIDNO:3582); XM_005626885.1, LOC102156133, Del, A_8, KRFKRGKQKG, (SEQIDNO:3583); XM_014111411.1, LOC611589, Del, A_8, KRGMKRKRKVQLEKRMRRH, (SEQIDNO:3586); XM_546411.5, SRPR, Del, A_8, KRGPRRRALMALWLRAKQFLPKSQVSQRGQRTG, (SEQIDNO:3587); XM_014118978.1, AKAP9, Del, A_8, KRGRLQAVNMMCQHTM1, (SEQIDNO:3588); XM_005618163.2, MSH3, Del, A-8, KRGTFSLESWECSLSQVRLCLIVSKTLLPVRS, (SEQIDNO:3589); XM_005626849.2, TSTD2, Del, A_8, KRHLPFSSKPKKFQHLLLNVKISGGNAVNSSSETR-SASTDMQQHNMLMRFATRLLL C, (SEQIDNO:3590); XM_014119254.1, DMRTA2, Ins, A_8, KRKAREALEL-LEAGLSRPSHAARRAPAAPLAQL-PAAPSWPPPVPVRGDPSPRWAPG CRRDPHAVPRSSR-SPAGADVGPRGGPEGAAPTRHPSF1, (SEQIDNO: 3591); XM_005639390.2, LOC487951, Del, A_8, KRKCSSSRT, (SEQIDNO:3592); XM_005626022.2, EIF5B, Del, A_8, KRKDKKAKNKVLMIMIVKNG-KIKIQNQKRLQSQKWKCTLGVMMMMMILINFLKKL KGKCRNQIKGGMGQKKMRITVKELKSVPE, (SEQIDNO:3593); XM_844389.4, DNAJC1, Ins, A_8, KRKEKKDRQQECGCIKTWCFRKK, (SEQIDNO:3594); XM_005623762.2, DDX24, Del, A_8, KRKEKKNWSL-PRVLLQRCPKKQRHGCLKCMTIRQM, (SEQIDNO: 3595); XM_848505.4, TWISTNB, Del, A_8, KRKENTVRKLNLPHFWNIHLKRKGES, (SEQIDNO: 3596); XM_542577.3, NUFIP1, Del, A_8, KRK-ERNQFFIVFVIPVIVVLKIKKSMINTCLNT, (SEQIDNO: 3597); XM-014108520.1, ZCRB1, Del, A_8, KRKFLSQKKKLKK, (SEQIDNO:3598); XM_014107724.1, LOC478037, Del, A_8, KRKGTARLTTVTS, (SEQIDNO:3600); XM_533087.4, PNPLA8, Del, A_8, KRKINIS-RKNQNLKIKRLKKRKQALQILAS, (SEQIDNO:3602); XM_014114461.1, LOC612426, Del, A_8, KRKISC-CRVKMHLSIIPRQRISNFQSP, (SEQIDNO:3603); XM_005623148.2, NLRP3, Del, A_8, KRKITARSTKNT, (SEQIDNO:3604); XM_014116142.1, CLMN, Del, A_8, KRKKGSMWTT, (SEQIDNO:3606); XM_014117385.1, HMGXB4, Del, A_8, KRKKKRRKTEREREEKSQKRRT-CQPTRSSVKSIG, (SEQIDNO:3607); XM_014116686.1, LOC100686205, Del, A8, KRKRCLSGRHLWHCI-MFCRCCSNDMQKTALLGWNSFTDSWICTNL-SPLKSRGFS, (SEQIDNO:3608); XM_847157.4, PHF20, Del, A_8, KRKRKRKPNLNALAVRRSVIPPRNLLH-PRHLLSTGVGPHISLGSI, (SEQIDNO:3609); XM_005638144.2, MTDH, Del, A_8, KRKRR-SKVKITLLHRTQKN, (SEQIDNO:3611); XM_005621925.2, EVI5, Del, A_8, KRKSK-LRSLFVKGYPTTLEQ, (SEQIDNO:3612); XM_005625956.2, APPL2, Del, A_8, KRKTRRQR1R1, (SEQIDNO:3613); XM_005617083.2, LOC100856304, Del, A_8, KRKWWHFY, (SEQIDNO:3614); XM_014112089.1, LOC608294, Del, A_8, KRKWWYFY, (SEQIDNO:3615); XM_014107459.1, CCL20, Del, A_8, KRLCVQIQRRNG, (SEQIDNO:3616); XM_531814.5, MSH6, Del, A_8, KRLLIFF11, (SEQIDNO:3617); XM_014115260.1, AHCTF1, Del, A_8, KRLLKELKNP, (SEQIDNO:3618); XM_014106956.1, ADNP, Del, A_8, KRLPCKVTESS, (SEQIDNO:3619); XM_546398.5, NFRKB, Del, A_8, KRLRKKRRKRRKK, (SEQIDNO: 3620); XM_005631775.2, ZNF330, Del, A_8, KRLVR-GRRQRAVGNVKNSSEHREAPSIWLNTHAM-HQWNVTSVRGGRRIERFATSA TLYRSYQFVHSVGKRSA, (SEQIDNO:3621); XM_014108948.1, MARVELD2, Del, A_8, KRMIPRFWKKKNAVII, (SEQIDNO:3622); XM_003639706.3, RIF1, Ins, A_8, KRNGFCKI, (SEQIDNO:3623); XM_014111626.1, THOC2, Del, A_8, KRNGTVQEERKRRNSPRTSTD, (SEQIDNO:3626); XM_005632360.2, LOC102156781, Del, A_8, KRN-LAWETSSENQT, (SEQIDNO:3628); XM_014120446.1, EML4, Del, A_8, KRNLILMIKVHKFEHHLLPSPLHSL-SKYTDKLKKARILLPPKA, (SEQIDNO:3629); XM_014111981.1, HBS1L, Del, A_8, KRNLTDLKVKRN, (SEQIDNO:3631); XM_014111745.1, CXHXorf23, Del, A_8, KRNMQTLPQQS, (SEQIDNO:3632); XM_844090.4, INO80, Del, A_8, KRNSRRKRNLKPS, (SEQIDNO:3633); XM_014112635.1, LIAS, Del, A_8, KRNSYKMDQTFKILYLEILQTRASGMNIKET, (SEQIDNO:3634); XM_533976.5, TAF1D, Del, A_8, KRNVKRGNISQKKDQGEDQKEEKPLDAPK, (SEQIDNO:3635); XM_005626240.1, EML6, Del, A_8, KRNWLRSWLSSTCLATGASTVATTCIT, (SEQIDNO: 3636); XM_014111557.1, TRPC5, Del, A_8, KRPATGHLS-SELCQEPVAPKGSQNLSHRANAPSWVLLSRNS-VSCFPSSMVICPNQVQ SQCTPFRMALLN-STTCGKTSDILRWRKGKQGPVLRVK, (SEQIDNO: 3637); NM_001003306.2, ATP1A1, Del, A_8, KRPRKKGIWMN, (SEQIDNO:3639); XM_005627403.2, HSP90AB1, Del, A_8, KRPRRLRKNTLIKKN, (SEQIDNO:3640); XM_014113698.1, SGIP1, Del, A_8, KRPRRLSFSSPLASGSEPSR, (SEQIDNO:3641); XM_003432745.3, ATP2B2, Del, A_8, KRPTCTRRRNL-CYRANSPSWLCRSARRVW, (SEQIDNO:3642); XM_844389.4, DNAJC1, Del, A_8, KRQAARVWMHQNLVLQKKMKDY, (SEQIDNO:3643); NM_001003264.1, SRP72, Del, A_8, KRRENYLKIMTQR, (SEQIDNO:3644); XM_014111841.1, ZC3H12B, Del, A_8, KRRFPLSHTVSSIDHPA, (SEQIDNO:3645); XM_005621668.2, SRRM2, Del, A_8, KRRKIED-AGQRAALLEEKGRRALRRRSTGQSLNPKNE-SIGLPLQRANVNLRTRSGSG LEVQHQP-PRAAGPTVQRLLTLLPLPILLAVGLEVRQQKPIQLP, (SEQIDNO:3646); XM_545754.6, ATP1A4, Del, A_8, KRRLIWRS, (SEQIDNO:3648); XM_014108254.1, LMAN1, Del, A_8, KRRNSRRAILTFSGILQTKYLRV, (SEQIDNO:3650); XM_005615362.2, LMAN1, Del, A_8, KRRNSRRAILTFSGILTKYLRV, (SEQIDNO:3651); XM_531629.4, PA2G4, Del, A_8, KRRPPRLQRM-PPVGKH, (SEQIDNO:3652); XM_005621118.2, USP42, Del, A_8, KRRRKRRGTPGNPRTLLKTQNRTSPRP-PAMRLLTVSGDWTAPSPSPTGCLWKVSGLS VRRENT, (SEQIDNO:3653); XM_848505.4, TWISTNB, Del, A_8, KRRRKTQSPMKWRVITES, (SEQIDNO:3654); XM_014114295.1, LOC106558887, Del, A_8, KRRSAR-HLHSDDPRPCVYEGSRNILERAPPGETSLITMPSSSSP, (SEQIDNO:3655); XM_535515.5, ZNF609, Del, A_8, KRRSLPRNSKVL, (SEQIDNO:3656); NM_001003113.1, KCNCI, Del, A_8, KRSIFHGHRSWDLPIIVNLS, (SEQIDNO:3657); XM_014118174.1, GRIK2, Ins, A_8, KRSIGKESQD, (SEQIDNO:3658); XM_539059.5, GRIK2, Ins, A_8, KRSIGKEVLL, (SEQIDNO:3659);

XM_014118176.1, GRIK2, Ins, A_8, KRSIGKGIFYLVS-ATLPSRHCL, (SEQIDNO:3660); XM_005625840.2, DNAJB7, Del, A_8, KRSIKRYRRSQPKEIV, (SEQIDNO:3661); NM_001003081.1, ABCC2, Del, A_8, KRSLGPQKSFPSPGWSRVSSKLSMSYS, (SEQIDNO:3662); XM_005633326.2, CEP57, Del, A_8, KRSQNHLKRKVLGTILLYNHIIDYAWGICR1, (SEQIDNO:3663); XM_005629478.2, LUC7L2, Ins, A_8, KRSRGSLSEFYASFQFPTTETSSI, (SEQIDNO:3664); XM_535194.5, KIN, Del, A_8, KRSRTLMMRKKQPNLLKNK, (SEQIDNO:3665); XM_005638465.2, RNFLL1, Ins, A_8, KRSVSPKKICIAPQF, (SEQIDNO:3666); XM_014119790.1, IQCAI1, Del, A_8, KRTKRKIRKKKMRKKRGNRRKGRVGRGKQTQC, (SEQIDNO:3667); XM_546107.5, TFAM, Ins, A_8, KRVNNAWKT, (SEQIDNO:3669); XM_014120722.1, SYCPI, Del, A_8, KRVQQKASN, (SEQIDNO:3670); XM_005619838.2, CWF19L2, Del, A_8, KRVRNRSMKKAMSQQTVHQALKMSGLRLSHRRLLAGKRPGK, (SEQIDNO:3671); NM_001005870.1, RXFP2, Del, A_8, KRVSPHPLCGQMTPLHLNLGF, (SEQIDNO:3672); XM_014117985.1, CNTLN, Del, A_8, KSALWVVTTLFSITPSRL, (SEQIDNO:3673); XM_014121947.1, IL17RB, Del, A_8, KSASRQEVCGIQTSLLARRTRRR, (SEQIDNO:3674); XM_005618733.1, HTRA3, Del, A_8, KSCRRCCWDARQTCGPASLWWPSAAPSPYRTR, (SEQIDNO:3676); XM_014112788.1, LSM11, Del, A_8, KSESPKWITSRYSLDT, (SEQIDNO:3677); XM_014116993.1, NUP214, Del, A_8, KSFLAHHFMSQIILSEFWMCCGSVLMSSQLCMLLRMGPWKLLQMW, (SEQIDNO:3678); XM_014107402.1, ZMYM2, Ins, A_8, KSFNNGKQSMSSIPSVFLMWNR, (SEQIDNO:3679); XM_014108759.1, ZFAND4, Ins, A_8, KSFRKM, (SEQIDNO:3680); XM_014122796.1, SWAP70, Ins, A_8, KSHQESPAHYRRRCI, (SEQIDNO:3681); XM_005619774.2, C5H11orf57, Del, A_8, KSHTKNRRKAKKKPQI, (SEQIDNO:3682); XM_534964.5, KIF11, Del, A_8, KSIHRNFAS, (SEQIDNO:3683); XM_005627188.1, C12H6orf10, Del, A_8, KSIKTRWLKRTRI, (SEQIDNO:3685); XM_014116982.1, TTF1, Del, A_8, KSIRKKREKFHTTRNLRHWLGLVVSRMCTPKDGKGSVKLGPQKNGKGSVKLGLLVE, (SEQIDNO:3686); XM_014118114.1, SENP6, Del, A_8, KSIRTLIQQKHL, (SEQIDNO:3687); XM_536616.5, GABARAP, Del, A_8, KSIWCLLISQLVSSTS, (SEQIDNO:3688); XM_005630143.2, NBAS, Del, A-8, KSKIESPSTH, (SEQIDNO:3689); XM_005615655.2, AKAP7, Del, A_8, KSKKVINPTISYPFRSPTKRLREELRSCKMQYSSKMSD, (SEQIDNO:3690); XM_014109018.1, HECTD2, Del, A_8, KSLFKETQNNR, (SEQIDNO:3691); XM_005619382.2, NIPBL, Del, A_8, KSLILSFQRVKQNKMKVDWQNLNQMKTDWWRQNQVKVS, (SEQIDNO:3692); XM_014115507.1, PIEZO2, Del, A_8, KSLQKKNRKEEEKDLGRVLWSGKTERMNQSKRNPMDQIISSRGYLIF, (SEQIDNO:3693); XM_853836.4, TCERG1, Del, A_8, KSLRKILGALSSPPATGKNKESLKNTSETNTSQPKLTSGRF, (SEQIDNO:3694); XM_014117866.1, FBXO10, Del, A_8, KSLTHGAW, (SEQIDNO:3695); XM_014117483.1, LIPT1, Del, A_8, KSMIECRI, (SEQIDNO:3697); XM_545015.5, TBCK, Ins, A_8, KSNLERSED, (SEQIDNO:3698); XM_014109263.1, ST18, Ins, A_8, KSNPGQSCTPNF1, (SEQIDNO:3699); XM_005635021.2, SAMHD1, Del, A_8, KSNTVNTSMWVRLSQREK, (SEQIDNO:3700); XM_014117917.1, ZNF483, Del, A_8, KSPLCVKNVGKF, (SEQIDNO:3701); XM_014106985.1, ZMYND8, Del, A_8, KSPNWPTQWRLRRS, (SEQIDNO:3702); XM_014109477.1, STARD9, Del, A_8, KSPTLCGSESTQSWGPMYKVYLNM, (SEQIDNO:3703); NM_001003154.2, TRDN, Del, A_8, KSQGKLLKPNKGL, (SEQIDNO:3704); XM_014120832.1, YAE1D1, Ins, A_8, KSQLPHILPIRDRSFQRFFSGNKFPLEGEGFPTHTKTHTPTPRSRVARSSSDCARPAP, (SEQIDNO:3705); XM_005618620.2, WDR19, Del, A_8, KSQTVPSTCEQRWSS, (SEQIDNO:3706); XM_005632059.2, ZXDC, Del, A_8, KSREELGAMQEPQVPLRGK, (SEQIDNO:3707); XM_014120778.1, CACNA2D1, Ins, A_8, KSRGRSFIVVAGVWQCHRPSPILSSFSMG, (SEQIDNO:3708); XM_844360.4, C16H4orf47, Ins, A_8, KSRQSLPP, (SEQIDNO:3710); XM_543550.5, LOC486424, Del, A_8, KSRRMEVLQSPAAHIAAVLLAARTVLSLSGSRV, (SEQIDNO:3711); NM_001346066.1, KRT26, Ins, A_8, KSRVGNESPAVCSGRGCECGGERSPRCGPHSPAEQHEGRV, (SEQIDNO:3712); XM_014106438.1, ER1CH6B, Ins, A_8, KSSCCCSS, (SEQIDNO:3713); XM_014115507.1, PIEZO2, Del, A_8, KSSGGGLGLIMLPWSGVEIIICLKRIVKRKKKKN, (SEQIDNO:3714); XM_532971.5, RNF103, Del, A_8, KSSHMHNTSPCQMMSH1, (SEQIDNO:3715); XM_005629390.2, TMA16, Del, A-8, KSSIHIVEKQLKLQERSTNKKKRKN, (SEQIDNO:3716); XM_005640282.2, LRP2, Del, A_8, KSSKLARNQIAVSHQQ, (SEQIDNO:3717); XM_014110629.1, SLC17A1, Del, A_8, KSSKLTPPLKL, (SEQIDNO:3718); XM_005620448.2, CHD5, Del, A_8, KSSRTRRRRKPSGKGRMMTRMIMMMGV, (SEQIDNO:3719); XM_005637015.2, FAR2, Del, A_8, KSSTPWSG, (SEQIDNO:3720); XM_014121223.1, CCDC73, Del, A_8, KSSYIFWLKKIIRSNSMKLRNIMAQ, (SEQIDNO:3722); XM_536037.5, CARF, Del, A_8, KSVNKRAGLVSSTKPLVQPGFILKRYRSFLNMEFLQTPKLTRK, (SEQIDNO:3724); XM_005628540.2, COL28A1, Del, A_8, KSVRILIPTSFKFWVHRHFNLDLGHQGKNLVNPLQSLGRKFQRLSVSLELRTKRMSLQSLPGLAAWPPVLHLRLLPPSSQKMGQRVSNPEFQVLF, (SEQIDNO:3725); XM_014106258.1, OXGR1, Del, A_8, KSVTQTTL, (SEQIDNO:3726); XM_843419.4, MICU3, Del, A_8, KSWGQWTSMMLLTCTVDQGIFWIAVGKFPVGYTGQKFRREICAIAIDWEITKC, (SEQIDNO:3727); XM_545733.5, SPTA1, Del, A_8, KSWQMMKIIRIYRT, (SEQIDNO:3728); XM_014106875.1, ZSWIM6, Del, A_8, KSYPIKASLR, (SEQIDNO:3729); XM_852167.4, ACVR2A, Del, A_8, KTALKCIFVAVRAICVTKGFLIFRRWKSHSLLRTQLHLSHPITTYCFIPWCHLC, (SEQIDNO:3730); XM_005630696.2, LOC608067, Del, A_8, KTATACMAGPLHSVRR, (SEQIDNO:3731); NM_001003252.1, CD4, Del, A_8, KTCGTKDPFLWSSRISKLLTQGFTSVTQTRGKRWNCWCST, (SEQIDNO:3732); XM_014111157.1, COPA, Del, A_8, KTCPLVQWSPT, (SEQIDNO:3733); XM_005628506.2, ANKIB1, Del, A_8, KTHPYTMLLPQG, (SEQIDNO:3736); XM_005618621.2, RFC1, Del, A_8, KTKEKEKLAQLRRNQNLKEVDLLPRRTA1, (SEQIDNO:3737); XM_544914.5, TRAPPC10, Del, A_8, KTKPTSFPELLLWTK, (SEQIDNO:3738); XM_005634774.2, ESF1, Del, A_8, KTLFGIVQTHVPKENSAQETWASLKLQNVPRSSTLRQEDKCNQWFHY, (SEQIDNO:3739); XM_014109172.1, PRKDC, Del, A_8, KTLKRCMKECMQLWEI, (SEQIDNO:3740); XM_005635921.1, RBM44, Del, A_8, KTLMQRWP, (SEQIDNO:3741); XM_014118174.1, GRIK2, Del, A_8, KTLNWKREPRLSYLKTMYSSPFWSQIFPFLQCCH- HHHLHHHYHHVL, (SEQIDNO:3742); XM_539059.5, GRIK2, Del, A_8, KTLNWKRGPSVAPW, (SEQIDNO:3743); XM_014118176.1, GRIK2, Del, A_8, KTLNWKRNLLFG, (SEQIDNO:3744); XM_014112562.1, FAM193A, Del, A_8, KTLQKRNACTISKMLLWKRTKL, (SEQIDNO:3745); XM_014119437.1, CEP290, Del, A_8, KTMNLSNIWMKFRL, (SEQIDNO:3746); XM_005634454.2, CEP63, Del, A_8, KTMTGSLNQHTTEHLSSRIQSSSQPMARTDMME, (SEQIDNO:3747); XM_005635698.2, ADAM28, Del, A_8, KTMVSLLLVTRKHIIIPLERRSPQAHKSWMTAITKDTSLMKRFQMLASAHVGV, (SEQIDNO:3748); XM_005622133.1, ZRANB2, Ins, A_8, KTNKITVTRKAPQVIFWIIPFWFPFKFKKEI, (SEQIDNO:3749); XM_014111710.1, BRWD3, Del, A_8, KTPPQEQQSTVGVIS, (SEQIDNO:3751); XM_014119900.1, WDR60, Del, A_8, KTPSRPMFSTMRIMLTETSRQKRLRPGGCGRSTPERARLCQG-GAGVEMSVRWPQPR RSTRPGWPASFALLAR, (SEQIDNO:3752); XM_014118253.1, CD2AP, Del, A_8, KTPWMNLELRLLNCCAL, (SEQIDNO:3753); XM_005640790.1, LEMD1, Del, A_8, KTQFLKYKSSRKR, (SEQIDNO:3754); XM_005623463.2, LOC490717, Del, A_8, KTQKDQYCPRI, (SEQIDNO:3755); XM_847012.4, PDCD1LG2, Del, A_8, KTQQKTLSPP, (SEQIDNO:3756); XM_014106624.1, TRPC1, Del, A_8, KTQWGQPLKE, (SEQIDNO:3757); XM_014120723.1, SYCP1, Del, A_8, KTRKHRHLY, (SEQIDNO:3758); XM_862709.4, FBXO38, Del, A_8, KTRMFIPAAAAPPPAQWEPPAHTALLLKAPT1, (SEQIDNO:3759); XM_005625593.2, HE1B, Del, A_8, KTRPRTVHGSFLR, (SEQIDNO:3760); XM_537131.4, DYRK3, Del, A_8, KTSFRVLASS, (SEQIDNO:3761); XM_014119301.1, APAF1, Del, A_8, KTSRIFPA, (SEQIDNO:3762); XM_014111529.1, SMC1A, Del, A_8, KTSRLNARKPNRRKKRLTATSA, (SEQIDNO:3763); XM_005616083.2, PEG3, Del, A_8, KTSSIGTMRP1, (SEQIDNO:3764); XM_014116241.1, RNF213, Del, A_8, KTSTTFSTRKALWKAPLRNAFSIS, (SEQIDNO:3765); NM_001197076.1, ASPM, Del, A_8, KTTQTAGLRLS, (SEQIDNO:3767); XM_536025.4, BZW1, Del, A_8, KTTSQNPLSLE, (SEQIDNO:3768); XM_853584.4, TGFB2, Del, A_8, KTVGRPHISC, (SEQIDNO:3769); XM_014117078.1, RABGAP1, Del, A_8, KTVLSLVTTSRFVLN, (SEQIDNO:3770); XM_005638026.2, MYBL1, Del, A_8, KTVVTVQTMRLF1, (SEQIDNO:3771); XM_014107325.1, BRCA2, Del, A_8, KTVYRMTQKNQLCL, (SEQIDNO:3772); XM_005638791.2, LTN1, Del, A_8, KVCFQSCQLWCVKVVGVWPLSYILIFCHLSANCLRPLQIQSWISSEISSPL, (SEQIDNO:3773); XM_014115507.1, PIEZO2, Ins, A_8, KVCKRRTEKKKKRIWGGSCGVGRPRG, (SEQIDNO:3774); XM_843419.4, MICU3, Ins, A_8, KVGGSGHR, (SEQIDNO:3775); XM_014121947.1, IL17RB, Ins, A_8, KVHRGRKSVGSRHHCLQEERDDGRSEFYNQPSWKQIHGSHPK, (SEQIDNO:3776); XM_533539.4, KIAA0020, Ins, A_8, KVHRKRCKDITRKKKIS, (SEQIDNO:3777); XM_014106438.1, ERICH6B, Del, A_8, KVILLLFVLRRKLK, (SEQIDNO:3778); XM_005628374.2, COPG2, Ins, A_8, KVKIWAETNLSCDPVGGSYIPARTVV, (SEQIDNO:3779); XM_014117985.1, CNTLN, Ins, A_8, KVLCGSLPHCSQSLHQGYEQCV, (SEQIDNO:3780); XM_540963.4, KIAA1109, Del, A_8, KVLITQMMKH, (SEQIDNO:3781); XM_014109477.1, STARD9, Ins, A_8, KVLLSAGQRAPRVGALCTRFISTCSYQL, (SEQIDNO:3782); XM_538101.4, TNMD, Del, A_8, KVLNKTSSGWSPK, (SEQIDNO:3783); XM_005630347.2, CEBPZ, Del, A_8, KVLRKTQKMKI, (SEQIDNO:3784); XM_547684.5, SPIRE1, Del, A_8, KVLTKSSWTSSDQDP1, (SEQIDNO:3785); XM_005618927.2, JMJD1C, Del, A_8, KVQTQLHV, (SEQIDNO:3786); NM_001003203.1, SCN10A, Ins, A_8, KVRGPGHLHDRGAKEV1, (SEQIDNO:3787); XM_014120929.1, AP2A2, Ins, A_8, KVRLQVALHLPPGS, (SEQIDNO:3788); XM_005622047.1, NEXN, Del, A_8, KVRPHLLIK, (SEQIDNO:3789); XM_844680.4, TM9SF3, Del, A_8, KVSVITMKLWEKHFKELNWNLVAWILNSKRM, (SEQIDNO:3790); XM_005619774.2, C5H11orf57, Ins, A_8, KVTQKTEEKQKRSHRYNSRFLK, (SEQIDNO:3791); XM_005635475.2, PDS5B, Del, A_8, KVTRETTLIFLNWTNLEAGKKHLSQIQKRN, (SEQIDNO:3792); XM_543139.5, PDSSB, Del, A_8, KVTRETTLIL, (SEQIDNO:3793); NM_001003343.1, DMD, Del, A_8, KWKTAMDLI, (SEQIDNO:3795); XM_005635654.2, MTMR9, Ins, A_8, KWNGNHAKRSATHWHKWEKVQRRREADKCYPQGRKTRLHH, (SEQIDNO:3796); XM_014120087.1, LOC607729, Ins, A_8, KWPLDQFLHFYTCPYFNCHCCP, (SEQIDNO:3797); XM_539294.3, LOC482175, Ins, A_8, KWPTPLRGIFNQ, (SEQIDNO:3798); XM_005634201.2, CLASP2, Del, A_8, KWVLICLGLYRQKFRKPLMLQENLFQMIFSLIF, (SEQIDNO:3800); XM_014115681.1, RALGAPA1, Ins, A_8, KYDLGRSTCRTSFPDSYSCLDQSKSKCIHLSRTMG, (SEQIDNO:3801); XM_005623314.2, ARHGAP5, Ins, A_8, KYDRKFLFI, (SEQIDNO:3802); XM_014110029.1, MRPL1, Ins, A_8, KYERQSIR, (SEQIDNO:3803); XM_849546.1, MMP20, Ins, A_8, KYFDIQNFQIHILHESC, (SEQIDNO:3804); XM_005634064.2, CCDC168, Ins, A_8, KYFTSIEKRRYRRNQYLTRFKRTQVSLY, (SEQIDNO:3805); XM_014120336.1, LOC100685565, Ins, A_8, KYIPCSNL, (SEQIDNO:3806); XM_014115024.1, SETBP1, Del, A_8, KYIRERMSV, (SEQIDNO:3807); XM_540001.4, LONRF1, Del, A_8, KYMMKKLLSSHT, (SEQIDNO:3808); XM_005637237.2, CHD4, Ins, A_8, KYQTTFHVQYCRWWFY, (SEQIDNO:3809); XM_547304.5, BCL10, Del, A_8, KYSVEKTLKKFLAEHQAGKGPENC, (SEQIDNO:3810); XM_005626151.2, UGP2, Del, A-8, KYYRSTIIVV, (SEQIDNO:3811); XM_014116764.1, ATAD5, Ins, A_8, MFCPCFSLFKFSH, (SEQIDNO:3812); XM_005623023.2, ROCK1, Ins, A_8, MGNTFGKEDP, (SEQIDNO:3813); XM_014114827.1, CCDC18, Ins, A_8, NAVRTAFNIRRKPEGSDLYPVRLI, (SEQIDNO:3814); XM_014122375.1, DNAH12, Del, A_8, NDFSSLAFSSYLMMKC, (SEQIDNO:3815); XM_535698.4, LARP7, Ins, A_8, NDIPNEIRVKNGNKWSTYYI, (SEQIDNO:3816); XM_537881.5, OSBPL1A, Del, A_8, NDLRKNKEQPAKTDPSRRRTGRRGGSTKAPTPTMEHRTGSTRAATGTETISICLTFI, (SEQIDNO:3817); XM_014111218.1, ZC3H11A, Ins, A_8, NEGKIQEARRRFFWSFQSFTPTSAHSRS, (SEQIDNO:3818); XM_014120749.1, HGF, Ins, A_8, NEHCRPMCQ, (SEQIDNO:3819); XM_005616957.2, LOC480753, Ins, A_8, NEISIRASKSGMGTRTLQFKIDLKTRKRKKKY, (SEQIDNO:3820); XM_005626020.2, REV1, Ins, A_8, NENRQVYTCCN, (SEQIDNO:3821); XM_547275.5, DNTTIP2, Del, A_8, NEWCKNAVLI, (SEQIDNO:3822); XM_546202.5, DCP2, Del, A_8, NFIHENFRIILKQMLYMTCLAPVKTSC, (SEQIDNO:3823); XM_014111472.1, CYLC1, Ins, A_8, NFPKAICLLNS, (SEQIDNO:3824); XM_014118166.1, MMS22L, Ins, A_8, NFQCRAATDV, (SEQIDNO:3825); XM_014113891.1, CAMTA1, Del, A_8, NFSRAGVLLC, (SEQIDNO:3826); XM_005624952.2, PAFAH1B1, Del, A_8, NGHLLL-DYKRRLWN, (SEQIDNO:3827); NM_001003343.1, DMD, Ins, A_8, NGKQQWILSK, (SEQIDNO:3828); XM_544640.4, VPS39, Del, A_8, NGSIKCSRTSSMQNF, (SEQIDNO:3829); XM_014120762.1, NAMPT, Del, A_8, NGVLKILPLVLVELCYRS, (SEQIDNO:3830); XM_014110770.1, UBR3, Ins, A_8, NHCSREENTGQRR-KATKG, (SEQIDNO:3831); XM_014120784.1, PC10, Del, A_8, NHLLKKKSQALKTKSYLQQQNHQL, (SEQIDNO: 3832); XM_005634505.2, COPB2, Del, A_8, NHLNQILELKVSMEASYWESD1, (SEQIDNO:3833); XM_005633761.2, MUC15, Ins, A_8, NHNTKHCSRFKNNGK, (SEQIDNO:3834); XM_014120114.1, SORBS2, Del, A_8, NHQLRHPFHH-PEKRAFVAP, (SEQIDNO:3835); XM_005637015.2, FAR2, Ins, A_8, NHRLHGVVRRCYY, (SEQIDNO:3836); XM_014119437.1, CEP290, Ins, A_8, NHYAGDEGIK, (SEQIDNO:3837); XM_014109018.1, HECTD2, Ins, A_8, NHYSKRLRTTDDKHRKAKSGG, (SEQIDNO:3838); XM_547250.5, FNDC7, Ins, A_8, NIFSNLL-WKYTWNGDLQGEKKCRM, (SEQIDNO:3839); XM_005634064.2, CCDC168, Ins, A_8, NIKAS-SIPHFKYKRNWFAC, (SEQIDNO:3840); XM_005636132.2, MPHOSPH9, Del, A_8, NIQKQPPTSMLIIALLPNCCQME, (SEQIDNO:3841); XM_005619774.2, C5H11orf57, Ins, A_8, NISSSKIIY-PRVSQTQEVQEIPQKKAEKKVTQKTEEKQKR-SHRYNSRFLK, (SEQIDNO:3842); XM_534832.5, PUS7L, Del, A_8, NISTGRGLFLNAKIKK-LYTQLLPYEKKIWKCLKHLDF, (SEQIDNO:3843); XM_014115143.1, HMCN1, Del, A_8, NITSKSMFLQ, (SEQIDNO:3844); XM_005641516.2, ATRX, Ins, A_8, NKEISRFGMHSSTLHGPW, (SEQIDNO:3845); XM_014114967.1, ASPM, Ins, A-8, NKGVQQSSSHY-TVHI, (SEQIDNO:3846); XM_014119437.1, CEP290, Del, A_8, NKKPIIKCLERKMELIKRMMN, (SEQIDNO:3847); XM_005636842.2, FAM186A, Del, A_8, NKKRLLKIRYH, (SEQIDNO:3848); XM_014110832.1, EIF4G3, Ins, A_8, NKNCGRKWRRS, (SEQIDNO:3849); XM_535848.5, SMC4, Del, A_8, NLAGFQEYMADWGI, (SEQIDNO:3850); XM_014112366.1, MPHOSPH10, Del, A_8, NLGSFKGK, (SEQIDNO:3851); XM_005638791.2, LTN1, Del, A-8, NLGSRILIY, (SEQIDNO:3852); XM_005618561.2, FAM200B, Del, A_8, NLIWQVFLK-MILG, (SEQIDNO:3853); XM_547249.5, STXBP3, Del, A_8, NLKTTTKLMKRAK, (SEQIDNO:3854); XM_005627570.2, IBTK, Del, A_8, NLLLAIVQEIM-SKKFVLKE, (SEQIDNO:3855); XM_005622945.2, PSMA8, Del, A_8, NLLPSFKMKEL, (SEQIDNO:3856); XM_005615312.2, ZNF407, Del, A_8, NLLRKWFP-LIRKENLLSP, (SEQIDNO:3857); XM_542274.5, TMEM126B, Del, A_8, NLNILEEKR1, (SEQIDNO:3858); XM_005618620.2, WDR19, Ins, A_8, NLRLYPVPANRG-GAV, (SEQIDNO:3860); XM_014107482.1, DNAJC18, Del, A_8, NLSMSGIKPGRVRGVPLTLRNSCLGYKGSR-NAEITMKFWEFLEMPVMKSLRKLIENL P, (SEQIDNO:3861); XM_005627467.1, PKHD1, Del, A_8, NLTGQN-REI, (SEQIDNO:3862); XM_538859.5, WDR46, Ins, A_8, NLVKRGGKFLEKGPPVK, (SEQIDNO:3863); XM_532048.4, RAB14, Del, A_8, NLWLIVLTQLVLNLVQE, (SEQIDNO:3864); XM_005631997.2, PRPF40A, Ins, A_8, NLYLEYKGG-SKASI, (SEQIDNO:3865); XM_014119671.1, LOC106559776, Del, A_8, NLYLYFSGQRIK, (SEQIDNO: 3866); XM_544335.4, GZMA, Ins, A_8, NMCWSPDCRRLGIDSSSLCPGQKFPGH-SWSSLNHQEGVGKTDNVC, (SEQIDNO:3867); XM_005630829.2, FLG, Del, A_8, NMHTTHKMKKT-TERKTK, (SEQIDNO:3869); XM_014116498.1, LOC476394, Del, A_8, NMKKTLQPITKISSIENIKNIIN-SIMIFL, (SEQIDNO:3870); XM_003432258.2, TCHHL1, Del, A_8, NMKQRTCLSKVISEMFQKYLMLKL, (SEQIDNO:3871); XM_014118235.1, DPCR1, Del, A_8, NPAIKEKTQISRIDALLILMTLLTHIKDCLVQNIQP, (SEQIDNO:3872); XM_534964.5, KIF11, Ins, A_8, NPFTGTLPVNRSLGRTILCLGGKV, (SEQIDNO:3873); XM_014118865.1, UTRN, Del, A_8, NPRVNGKKS, (SEQIDNO:3874); NM_001012395.1, UTRN, Del, A_8, NPRVNVKKS, (SEQIDNO:3875); XM_014122801.1, LUZP2, Ins, A_8, NPSPAEGASLREERFII, (SEQIDNO:3877); XM_546767.5, LOC489647, Del, A_8, NPTMFF-SFMLCLQLGMLWRIRWRL, (SEQIDNO:3878); NM_001110501.1, VEGFA, Del, A-8, NQFEERGRGKKE-SARNPVPVGLAQSGESICLYKIRRRVNVPAKTQTR-VARRGSLS, (SEQIDNO:3880); XM_005628633.1, STK31, Del, A_8, NQILVSLSSRTSKAPFPHG-GIDQTSQPSPDQRGA, (SEQIDNO:3881); NM_001003327.2, HSP90B1, Del, A_8, NQKPKKLRKLS-GIGS1, (SEQIDNO:3883); XM_014112357.1, LCOR1, Del, A_8, NQKQMRTSQTLTWKIIVLILMTVTLFRED, (SEQIDNO:3884); XM_014114844.1, HFM1, Del, A_8, NQKQRFPILNIQIDL1, (SEQIDNO:3885); XM_014106258.1, OXGR1, Ins, A_8, NQLLKQPL, (SEQIDNO:3886); XM_005635844.2, PSMD1, Del, A_8, NQLTRDWKAL, (SEQIDNO:3887); XM_014117518.1, FOXN2, Del, A_8, NQQLQSPHTPLVFSFTWLSNTLQ-INVCLSKKFIAGFWTASHILLLHQQAGRILFDIICP, (SEQIDNO:3888); XM_005641214.2, POLA1, Del, A_8, NQREGAKKL, (SEQIDNO:3889); XM_532160.5, ADGRF5, Ins, A_8, NRCHAHPNSGN, (SEQIDNO:3890); XM_003431930.3, PPP1R17, Del, A_8, NRGGKIHQHCT-SHLLYQVCFQNI, (SEQIDNO:3891); XM_005635161.2, STAU1, Ins, A-8, NRGWKKSNLF, (SEQIDNO:3892); XM_014118195.1, AK9, Del, A_8, NRKGRLVEKMKTLVKKSLKKMKMILTT-SLKMNFQKMRK, (SEQIDNO:3893); XM_005618393.2, BTBD1, Del, A_8, NRPWDKTILDSVAMELLTHSG, (SEQIDNO:3894); XM_005639600.1, WDR53, Del, A_8, NRRVLQNLPTGRKLKEQLIPSRVETLMFQ, (SEQIDNO:3895); XM_535855.5, PRKCI, Ins, A_8, NRSYL-CNESCEKRAGQ, (SEQIDNO:3896); XM_014111218.1, ZC3H11A, Ins, A_8, NRYKRREETSRRQ, (SEQIDNO:3897); XM_014115049.1, CAMSAP2, Del, A_8, NSAQNLFTEIILSLPKHQ, (SEQIDNO:3898); XM_014121441.1, LARP1B, Del, A_8, NSDKKFLKISKKKPKKTTNLVSCMD, (SEQIDNO:3899); XM_005630447.2, CKAP2L, Ins, A_8, NSGQGHKGYKG, (SEQIDNO:3900); XM_003640176.3, ITGA6, Del, A_8, NSGSQVGMKMKAT1, (SEQIDNO:3901); XM_534716.5, TCHP, Del, A_8, NSKKPLKRKRTNGLKMSMNGPEGKHWSG, (SEQIDNO:3902); XM_005618842.2, RAB4A, Del, A_8, NSKMTQIIQ, (SEQIDNO:3903); XM_534728.4, THOC5, Ins, A_8, NSKSSQSVSV, (SEQIDNO:3904); XM_014119165.1, LRGUK, Del, A_8, NSLFKER-PLKGQGI, (SEQIDNO:3905); XM_014119556.1, EEA1, Del, A_8, NSLNEKLKI, (SEQIDNO:3906); XM_005630261.2, EIF2B4, Del, A_8, NSRRRS-GRRKREQNQKKLPLLYLQPSSK, (SEQIDNO:3908); XM_005630260.2, EIF2B4, Del, A_8, NSRRRS-GRRKREQNQKKLPLLY- LQPSSKAQPKNCQDQAVSWPLLGRKFQLVEVKLN FVLNGGLSRRLSGP, (SEQIDNO:3909); XM_005623926.1, SERPINA14, Ins, A_8, NSSQDGHQ, (SEQIDNO:3910); XM_014111654.1, LOC106558442, Ins, A_8, NSSSIPFFLKNA, (SEQIDNO:3911); XM_005639464.1, BBX, Del, A_8, NSTAFLNIVLLHLTGNA, (SEQIDNO:3912); XM_540699.3, COR4C29, Ins, A_8, NSVCHFFVFLFG-DIAG, (SEQIDNO:3913); XM_014112114.1, LOC102151511, Ins, A_8, NTAEFPKHPRSL, (SEQIDNO: 3914); XM_005618891.2, FAM13C, Del, A_8, NTGLHMVTRLLILKS, (SEQIDNO:3915); XM_532882.5, SMC6, Del, A_8, NTKIFKINWKR, (SEQIDNO:3916); XM_014108478.1, KIF21A, Del, A_8, NTLQLKMGTLLQTLK, (SEQIDNO:3917); XM_005626151.2, UGP2, Ins, A_8, NTTE-VQSLSCENLHF, (SEQIDNO:3918); XM_003431851.2, LOC100686566, Ins, A_8, NVECGICLSGNSKV, (SEQIDNO:3919); XM_014117230.1, C1H9orf3, Ins, A_8, NVEITSAAI, (SEQIDNO:3920); XM_542572.5, ZC3H13, Del, A_8, NVKNPKAILIFLMKKQPCRIKRREVHGLPL, (SEQIDNO:3921); XM_014116764.1, ATAD5, Del, A_8, NVLPLFLTV, (SEQIDNO:3922); XM_014115269.1, DNAH14, Ins, A_8, NVLQLRRNSFRYRNHG, (SEQIDNO:3923); XM_547651.5, THOC1, Del, A_8, NVPLTKLSEVF, (SEQIDNO:3924); XM_014111411.1, LOC611589, Del, A_8, NVSHWMRWDD, (SEQIDNO: 3925); XM_534660.5, VPS33A, Del, A_8, NVSQEKTESL, (SEQIDNO:3926); XM_014120072.1, WRN, Del, A_8, NWKELHSRENFLNGCLCRMRHVLQ, (SEQIDNO: 3927); XM_005617468.2, BDP1, Ins, A_8, NWKRQLSQREDTRNNG, (SEQIDNO:3928); XM_005626458.2, CSNK1G3, Ins, A_8, NWMWQF-WRITIREKFIYK, (SEQIDNO:3929); XM_543181.4, CENPJ, Ins, A_8, NWWFFRSG, (SEQIDNO:3930); XM_544601.6, ARHGAP11A, Del, A_8, NYDYRLQWCRLL-LIMHQILGMFQILSRKRYQLCWVLMVSVLLHH, (SEQIDNO:3931); XM_005624786.2, TADA2A, Ins, A_8, NYKRPWINQP, (SEQIDNO:3932); XM_005630987.1, FBXL13, Del, A_8, NYLQKHYCEYERCATITS, (SEQIDNO:3933); XM_544672.5, SECISBP2L, Del, A_8, NYRKLYQRQLEKRIKPLCS, (SEQIDNO:3934); XM_005621465.2, ACSM3, Ins, A_8, NYSTLQ-ISQKGRIYSRAAKDYQWEDKEK, (SEQIDNO:3935); XM_005618927.2, JMJD1C, Ins, A_8, RCKLSYMSKIL, (SEQIDNO:3936); XM_005631921.2, NCKAP5, Ins, A_8, RCKRFGVWKQTTKIGEKEREKEA, (SEQIDNO:3937); XM_005627049.2, BRD2, Ins, A_8, REKEETEGREAS-RPSWG, (SEQIDNO:3938); XM_545510.4, SPC25, Ins, A_8, RELVKVGC, (SEQIDNO:3939); XM_005617083.2, LOC100856304, Ins, A_8, RENGGIFIRRSKYKCS, (SEQIDNO:3940); XM_544679.5, TMOD3, Ins, A_8, RENN-PETETYTDVHRRKSMS, (SEQIDNO:3942); XM_005641771.2, THOC2, Ins, A_8, RETGQFRRKGREETISFSSYWSF, (SEQIDNO:3943); XM_014111624.1, THOC2, Ins, A_8, RETGQFRRKGREETS, (SEQIDNO:3944); XM_014111626.1, THOC2, Ins, A_8, RETGQFRRKGREETVLGQAQI, (SEQIDNO:3945); XM_005626884.1, CYLC2, Ins, A_8, RFKKGQGVSYRI, (SEQIDNO:3946); XM_014118268.1, LAMA4, Ins, A_8, RFQFIGADGNSGSWLWMPRRLSYISQSIFQW-TEFHCFSSENVFLRWL, (SEQIDNO:3947); XM_544656.5, EIF3J, Ins, A_8, RGSRSKTR-SKSFRKEKNSRENKRERTATEEKARRN, (SEQIDNO: 3948); XM_846902.4, ZMYM5, Ins, A-8, RGTTRTKRKD-FRATGFGRMYRYLTDQTGCNFTFFCVNHS, (SEQIDNO:3949); XM_547682.5, AFG3L2, Ins, A_8, RIKASCYPEPFWRRNWWQWKTRWQER, (SEQIDNO: 3950); XM_014110862.1, PLA2R1, Ins, A_8, RIYMQNG-SRSSCSKGALRKRTKS, (SEQIDNO:3951); XM_005621912.2, MTF2, Ins, A_8, RKEKICRSSTGPNK-KNDSENC, (SEQIDNO:3952); XM_005620231.2, INAD1, Ins, A_8, RKETRNSSTSNETAASLQSSV, (SEQIDNO:3953); XM_537461.5, ARID4A, Ins, A_8, RLR-RINGRGFKSRSRNAFSGSEE, (SEQIDNO:3954); XM_005634532.2, TFDP2, Ins, A_8, RNQVDWLAYQFCSGMSKS, (SEQIDNO:3955); XM_014106274.1, LOC100685903, Ins, A_8, RNSQGLKSSTKQPTM, (SEQIDNO:3956); XM_005638329.2, ADAL, Ins, A_8, RNTSTSGSAS, (SEQIDNO:3957); XM_014120723.1, SYCP1, Ins, A_8, RQENTDTFIENT, (SEQIDNO:3958); XM_014120622.1, SPAG17, Ins, AS8, RRGLFFRRCERRKRGRAES, (SEQIDNO:3959); XM_005623419.2, WDHD1, Ins, A_8, RRGRFQKRAECWLQ, (SEQIDNO:3960); NM_001003212.1, F8, Ins, A_8, RRPCATTCRKSR-SIILQDTVLARLDKDPWQELPKL, (SEQIDNO:3961); XM_014118082.1, DST, Ins, A_8, RSCVFLSRTDGCFPSPC, (SEQIDNO:3962); XM_005638906.2, TTC3, Ins, A-8, RSKKISTRKN-GRGPKGK, (SEQIDNO:3963); XM_005628212.2, LOC475149, Ins, A-8, RSQTKIHRSPSVLRHLLFRTTS, (SEQIDNO:3964); XM_536500.4, NUP155, Ins, A_8, RSSGSWASF1, (SEQIDNO:3965); XM_014115932.1, KIAA0586, Ins, A_8, RSSSAYCTGIAQCGY, (SEQIDNO: 3966); XM_531830.5, MTIF2, Ins, A_8, RTKTFKAKR-ERRKGFTCTSYNY, (SEQIDNO:3967); XM_005634064.2, CCDC168, Ins, A_8, RWRKCSTCER-QNGPPACHFQRTENSF, (SEQIDNO:3968); XM_014117985.1, CNTLN, Ins, A_8, RYQTKFPSIKNK, (SEQIDNO:3969); XM_545493.4, IFIH1, Ins, A_8, SCTRRKSKRPCLCRAFEEVQ, (SEQIDNO:3970); XM_005632697.1, KIAA1683, Ins, A_8, SEHGGGGHPLPCPPAGAVPASWRGQAPSDPACH-GEQRDPVPF1, (SEQIDNO:3971); XM_857314.4, PHF20L1, Ins, A_8, SEIGRKKLNSIW, (SEQIDNO:3972); XM_005618326.2, CHD2, Ins, A_8, SESQKTCPQKN-SAQTSS, (SEQIDNO:3973); XM_014116993.1, NUP214, Ins, A_8, SHSLPTIL, (SEQIDNO:3974); NM_001168012.1, CCDC66, Ins, A_8, SKKADGTA, (SEQIDNO:3975); XM_014118899.1, CASD1, Ins, A_8, SKRKLFLAFWLTVETSLLAVMYMFFGIFSGCI, (SEQIDNO:3976); XM_014115839.1, BAZ1A, Ins, A_8, SKTESSEFSRTTNYSSFILDQPYPSFTLA, (SEQIDNO: 3977); XM_005631802.2, SCLT1, Ins, A-8, SQIKDQYNGT, (SEQIDNO:3978); XM_005624343.2, GJC1, Ins, A_8, SQSGVQSWVQQEQC, (SEQIDNO: 3979); XM_855716.4, CWC27, Ins, A_8, SRKCSKTSRKEK, (SEQIDNO:3980); XM_014120308.1, FAM228B, Ins, A_8, SSHLQKQRIIPSGKRTSMFS, (SEQIDNO:3981); XM_014120309.1, FAM228B, Ins, A_8, SSHLQVLF1, (SEQIDNO:3982); XM_014116745.1, HEATR6, Ins, A_8, SSLWLLVSLCT, (SEQIDNO:3983); XM_535760.5, FAM162A, Ins, A_8, SSPERGSS-CEGQDRV, (SEQIDNO:3984); XM_014118258.1, OGFRL1, Ins, A_8, SSTRRTWRGNRQS, (SEQIDNO: 3985); XM_014120252.1, SLC4A1AP, Ins, A_8, SSWSRQTSSNTFLQISRR, (SEQIDNO:3986); XM_844731.4, UBE4B, Ins, A_8, STKDVQ-PASSQPASQQHPLTVHIPYCVSPTRFPH-TTKVHAAAILPGAVYALQESPIWL HAGTGENHSPG, (SEQIDNO:3987); XM_005630260.2, EIF2B4, Ins, A_8, TAEEEAEGGKGSRTRKNCPCCTCSPAARPSQRTARTRQSVGHCWGESSNWSK, (SEQIDNO:3988); XM_005630261.2, EIF2B4, Ins, A_8, TAEEEAEGGKGSRTRKNCPCCTCSPAASRPSQRTARTRQSVGHCWGESSNWSK, (SEQIDNO:3989); XM_014115049.1, CAMSAP2, Ins, A_8, TAPKIYSQRSY, (SEQIDNO:3990); XM_005618393.2, BTBDI, Ins, A_8, TDPGTKRYWIQLRWNC, (SEQIDNO:3992); XM_014107997.1, KNTCI, Ins, A_8, TEAQAPEVNRS, (SEQIDNO:3993); XM_005617952.1, SZRD1, Ins, A_8, TEDHTKGEEIQISSQSAHCDSGR, (SEQIDNO:3994); XM_846908.3, SZRD1, Ins, A_8, TEDHTKGEQEIQISSQSAHCDSGR, (SEQIDNO:3995); XM_003431930.3, PPP1R17, Ins, A_8, TEEERYTSTAHPTFYTRCAFRTFN, (SEQIDNO:3996); XM_005639600.1, WDR53, Ins, A_8, TEESYKTYPQEEN, (SEQIDNO:3997); XM_003433496.3, HOXC11, Ins, A_8, TEQRPAAVFLGKSSAV, (SEQIDNO:3998); XM_014117181.1, R3HDM2, Ins, A_8, TGGRICKQKQVYF, (SEQIDNO:3999); XM_014121226.1, EIF3M, Ins, A_8, THPFKAP1, (SEQIDNO:4000); XM_014112366.1, MPHOSPHIO, Ins, A_8, TLAASRGSDSSKATREQPSRGDSAL, (SEQIDNO:4001); XM_014112968.1, LOC102154920, Ins, A_8, TLPYKSKQYILPKTQISEGWRGAPE, (SEQIDNO:4002); XM_547275.5, DNTTIP2, Ins, A_8, TNGAKTPF, (SEQIDNO:4003); XM_014119165.1, LRGUK, Ins, A_8, TPYSKRDH, (SEQIDNO:4004); XM_014118235.1, DPCR1, Ins, A_8, TQQSRKKPKYPE, (SEQIDNO:4005); XM_014119796.1, KDM7A, Ins, A_8, TRNNIKLQGGLYCDEELPSEGPEAI, (SEQIDNO:4006); XM_014119545.1, GALNT4, Ins, A_8, TRRDAKLSKRRVPCSSKHRLAF, (SEQIDNO:4007); XM_534660.5, VPS33A, Ins, A_8, TSARRKPSHSDIFPRGCNLC, (SEQIDNO:4008); XM_014111411.1, LOC611589, Ins, A_8, TSIANTRYY, (SEQIDNO:4009); XM_546202.5, DCP2, Ins, A_8, TSSTKTSG, (SEQIDNO:4010); XM_014122375.1, DNAH12, Ins, A-8, TTFLPSLFLLI, (SEQIDNO:4011); XM_544672.5, SECISBP2L, Ins, A_8, TTGSFIKGSWKKE, (SEQIDNO:4012); XM_544601.6, ARHGAP11A, Ins, A_8, TIITGCSGADSY, (SEQIDNO:4013); XM_005630987.1, FBXL13, Ins, A_8, TTYRSTIANTKDVPPLQANNYPD, (SEQIDNO:4014); XM_014118891.1, LOC607634, Ins, A_8, TVPLEACHWPLFLPTTVPSFRCKRRPVCMLGRLSVPVETTTGGLQWYPGPTCW, (SEQIDNO:4015); XM_544640.4, VPS39, Ins, A_8, TVQSSAQEPPPCRISEGPGRADFTPAGEVHHHRGEGVYGV, (SEQIDNO:4016); XM_861706.4, FMR1, Ins, A_8, TYRYKGKQHSFFST, (SEQIDNO:4017); XM_005618911.1, C4H10orf107, Ins, A_9, IEFQKPSHLFKGSHSTRLLCIWIFVG, (SEQIDNO:4018); XM_014108953.1, ZNF518A, Ins, A_9, IFKNKNSCKK, (SEQIDNO:4019); XM_014118548.1, RGS22, Ins, A_9, IGSHRRRKFCKGWNQTISKFFRICNQNSCFSH, (SEQIDNO:4020); XM_005626171.2, ETAA1, Ins, A-9, IKYSASIP, (SEQIDNO:4021); XM_532334.4, KCNQ3, Ins, A_9, IQGDFEALRREGCD, (SEQIDNO:4022); XM_005617803.2, STPG1, Ins, A_9, IQPCQQITERFYCRISNTILHSF, (SEQIDNO:4023); XM_014116147.1, ATG2B, Ins, A_9, IRLSEQELTEFSLCSSEYQSWINGSVYRCQAR, (SEQIDNO:4024); XM_014114898.1, LRRIQ3, Ins, A_9, ISSYHHATRCPRKS, (SEQIDNO:4025); XM_005622971.2, WDR64, Ins, A_9, ITKPSFRLKEL, (SEQIDNO:4026); XM_014106333.1, ERCC5, Ins, A_9, ITQAAAHTWLSQSSCCGCLPQTCGG, (SEQIDNO:4027); XM_014119213.1, TMEM196, Ins, A_9, IWTCHDPFFC11HLWTHWGHPEFSVSSGSDKEDLFSLPSASRLHVPCMHWDRWLHPVFLAHLSTSQLRTEEDVLRKGAFAAP1S, (SEQIDNO:4028); XM_005635476.2, PDS5B, Ins, A_9, IWTFSTRRRGRRRKTKWKHRTEVKEQTAPNIKESTTEPCRTLQTSSY, (SEQIDNO:4029); XM_005635474.2, PDS5B, Ins, A_9, IWTFSTRRRGRRRKTKWKHRTEVKEQTAPNIKESTTEQSRIS, (SEQIDNO:4030); XM_005635475.2, PDS5B, Ins, A_9, IWTFSTRRRGRRRKTKWKHRTEVKEQTAPNIKESTTESRIS, (SEQIDNO:4031); NM_001003300.2, KCNMA1, Ins, A_9, KAAERRHAELTQLLAQADEA, (SEQIDNO:4032); XM_003432210.3, TAF1B, Ins, A_9, KAFKFSVQLD, (SEQIDNO:4033); XM_536223.4, NOP14, Del, A_9, KASTTSMRMKN, (SEQIDNO:4034); XM_005623486.2, SYNE2, Ins, A_9, KCGTKATKTF, (SEQIDNO:4035); XM_005633326.2, CEP57, Del, A_9, KCKSWKQNSGKNNRKGNVCKLRQPSCRLG, (SEQIDNO:4036); XM_005635475.2, PDS5B, Ins, A_9, KCPCRTLQTSSY, (SEQIDNO:4037); XM_005627611.2, C12H6orf165, Ins, A_9, KCRINSVTGTSSTVRNPHSIFSNEGC, (SEQIDNO:4038); XM_005617981.2, PRDM2, Del, A_9, KCRLHPRKVDTRHLPAVTKTAAATGAGLQTRRLRCRACRLLWARPERAAPALRQA RCRPRPSGPSRMSNLQLR, (SEQIDNO:4039); XM_005617468.2, BDP1, Ins, A_9, KCSFRSWTIRKCWRKNWKR, (SEQIDNO:4040); XM_005620331.2, C5H1orf141, Ins, A_9, KDFGYTPDI, (SEQIDNO:4041); XM_533539.4, KIAA0020, Del, A_9, KDFIKTVILVRQRHSQGKLSRKVDLKSHLRTLRNVP, (SEQIDNO:4042); XM_005628464.2, DBF4, Del, A_9, KDIVNVACRNMKILKLIF, (SEQIDNO:4043); XM_005623289.2, SCFD1, Del, A_9, KDLLISIQMLPLLF, (SEQIDNO:4044); XM_532252.6, SEC63, Ins, A_9, KEAFKKKTYTCALTTVKATETKAGKWNCWE, (SEQIDNO:4045); XM_014114026.1, FUK, Ins, A_9, KECVLVGGGLVAELQQAWGWGQFLYLYSLRP, (SEQIDNO:4046); XM_533327.6, DDX18, Ins, A_9, KEEEKEKNGG, (SEQIDNO:4047); XM_005623020.2, ESCO1, Ins, A_9, KEEITSEKFSAWNF, (SEQIDNO:4048); XM_014110821.1, DYNCII2, Del, A_9, KEEKQKHCFKAWG, (SEQIDNO:4049); XM_535246.4, NDUFAF2, Del, A_9, KEKILKLKVNIFMKKKNSLAKGARKNSWLNQFKLRSKGMPRLHTLERKNLPWLPPALVKSFNRDPGCHKAARTQIN, (SEQIDNO:4050); XM_005624758.2, BCAS3, Del, A_9, KEKKNNANSPASVSNPTVTKQVFGMEEELQREGSIETLS, (SEQIDNO:4052); XM_005618622.2, RFC1, Del, A_9, KERVLIKKQSL, (SEQIDNO:4053); XM_014122469.1, LOC100686348, Del, A_9, KFPLIFPSYLMSYTM, (SEQIDNO:4054); XM_848407.3, LOC610853, Del, A_9, KFPLRFPSYLMSYTM, (SEQIDNO:4055); XM_014113182.1, JAK1, Del, A_9, KFQMLPLFLMPVLWSISLLRDSMIWSNAWLPFETPRLSRMGTILRMSVWEWLSWPS PTMP, (SEQIDNO:4056); XM_014113418.1, TBC1D32, Del, A_9, KFRRRKATTVTAQIIALNIHHSIRVTNFVKENYN, (SEQIDNO:4057); XM_014109094.1, KIF20B, Ins, A_9, KFYFKYRGPANSVEL, (SEQIDNO:4058); XM_014119810.1, KMT2C, Ins, A_9, KGARGQNYGSS, (SEQIDNO:4059); XM_014121826.1, LOC106560105, Ins, A_9, KGGGGCIISSPRWPSGSARSRCADDVSSTWASLGLFVLFSYAPALFSGGLLRSRS, (SEQIDNO:4060); XM_005627570.2, IBTK, Del, A_9, KGILKRKRFYQIFIIPHQMCLVSLI, (SEQIDNO:4062); XM_014114974.1, RNASEL, Del, A_9, KGISMRILRVIC, (SEQIDNO:4063); XM_005619174.2, UIMCI, Del, A_9, KGLGNQCYLDLL1, (SEQIDNO:4064); XM_003432210.3, TAF1B, Del, A_9, KGLQVFSSTGLKETLQEPVSTDMASRGF, (SEQIDNO: 4065); XM_003639290.3, SPAG9, Del, A_9, KGQAFGNFSADFSAPQVIQLRSLNHLLI, (SEQIDNO: 4066); XM_005616957.2, LOC480753, Del, A_9, KGRSRRVVKWKEQKTYMLLLLLD, (SEQIDNO:4067); NM_001006950.1, IL5, Del, A_9, KGVQEKDGE, (SEQIDNO:4068); XM_005635025.2, RBL1, Del, A_9, KHHLHLLPH, (SEQIDNO:4069); XM_014113145.1, SPEF2, Del, A_9, KHKYPHWLLMLAPPKKCLFPLLHLTLSCY, (SEQIDNO:4070); XM_014113312.1, CHEK1, Del, A_9, KHTLTLGKKLIQLLLLCCIKS, (SEQIDNO:4071); XM_005634176.2, GINS1, Del, A_9, KIASISYPDGSVSSWLDREFWSTCCP, (SEQIDNO:4072); XM_014111881.1, ZNF711, Del, A_9, KIIIQGTVVKEMKEEFPGGMKIVKHQEIPWTQH, (SEQIDNO:4073); XM_005640445.2, PMSI, Del, A_9, KILKNINLT, (SEQIDNO:4074); XM_005619458.1, EMB, Del, A_9, KINVLSHRGETSDLTALLR, (SEQIDNO:4075); XM_014110679.1, SP3, Del, A_9, KIPGPLRPCPPPLPASSPAAAAFAPHHVTLSRHRSPCWPLPAAR, (SEQIDNO:4076); XM_535304.5, CHD9, Del, A_9, KIQLLYLVNSLYNYLWRIQVKKMLQL, (SEQIDNO:4077); XM_005631118.2, EHF, Del, A_9, KIVAAGQTRPVSRS, (SEQIDNO:4078); XM_536037.5, CARF, Del, A_9, KIWTVRNYLPH, (SEQIDNO:4079); XM_014118792.1, ATP10D, Ins, A_9, KKKRKKKKKEKQGGGRGGRAVPAPGCPFGRRSCFSRFRARGGSRGGGLRARALPW RERAQITCIPRISAHFGHDRVSAMGQVSLAATNGRHKQG, (SEQIDNO:4080); XM_014116149.1, LOC100856221, Del, A_9, KKLDVIRSPLNF, (SEQIDNO:4081); XM_014116721.1, PRR11, Del, A_9, KKPLTLSPS, (SEQIDNO:4082); NM_001114605.1, ZC3H15, Del, A_9, KKRKKMKFH, (SEQIDNO:4083); XM_014110977.1, NBEAL1, Del, A_9, KKRNWQIRHLLKNL, (SEQIDNO: 4084); XM_014110821.1, DYNC1I2, Ins, A_9, KKRSRSIASKHGADSRIPHC, (SEQIDNO:4085); XM_005640306.2, DYNC1I2, Ins, A_9, KKRSRSIASKHGADSRIPHCFF, (SEQIDNO:4086); XM_014110819.1, DYNC1I2, Ins, A_9, KKRSRSIASKHGADSRIPHCPSSYVSILQICEHTK, (SEQIDNO: 4087); XM_850174.2, LOC612447, Del, A_9, KLERNRMERVKK, (SEQIDNO:4088); XM_005637010.2, FAM60A, Ins, A_9, KLESCGRCKGRTQSEDYFETKESENSIWKQDKKQPDQ, (SEQIDNO:4089); XM_014118898.1, LOC102152714, Del, A_9, KLKCNIKTLKNISSSS, (SEQIDNO:4090); XM_544621.5, RMDN3, Del, A_9, KLLQPCLKALSVPL, (SEQIDNO:4091); XM_014117774.1, RFX3, Del, A_9, KLLSWNS1, (SEQIDNO:4092); XM_005639177.2, HERC3, Del, A_9, KLMNILKQVPKSLGLT, (SEQIDNO:4093); XM_005623826.2, MOK, Del, A_9, KLRTICTSYVNPLIICTEMEYFTEM, (SEQIDNO:4094); XM_014115615.1, LOC100682643, Del, A-9, KLSPPVPPISLWSLSIMAPLSLPMFTLQRSTTSPLVK, (SEQIDNO:4095); XM_003431923.4, HOXA11, Del, A_9, KLTETVYSTTQPTRSS, (SEQIDNO:4096); XM_848625.3, ABCA9, Del, A_9, KLTHSYGFQASTLLLIGLARHWWIFHSTS, (SEQIDNO:4097); XM_014111056.1, DNAH7, Del, A_9, KLVMTLTLSG, (SEQIDNO:4098); XM_005638791.2, LTN1, Del, A_9, KLVRLDLLMSCLKVIKRMKNVSPQKARTVKALNQWLKLLLFLIVQTLYHH, (SEQIDNO:4099); XM_014107060.1, TCEB3, Del, A_9, KMIRKALIKTRIQFRNYLK, (SEQIDNO:4100); XM_005617468.2, BDPI, Del, A_9, KMLIQKLDHQEVLEKKLEEIILCL, (SEQIDNO:4101); XM_005616776.2, TDRD12, Del, A_9, KMLMLKKGNPHLIRLLPLEFIGADT, (SEQIDNO: 4102); XM_005623486.2, SYNE2, Del, A_9, KMWNKSYKNFLIS, (SEQIDNO:4103); XM_014112649.1, RBPJ, Del, A_9, KNKWNGMVVLNKSLNHVHLLE, (SEQIDNO:4104); XM_014111562.1, GLRA4, Del, A_9, KPCGNSMWTKPSRLTPSPGLSSLSLSSSSTPSTGLSIKCYGQKIFTRHC, (SEQIDNO:4105); XM_005639444.1, CRYBG3, Del, A_9, KPKSLVERVLEKWRKIPLKERKA, (SEQIDNO:4106); XM_005617337.2, KCTD16, Del, A_9, KPLRKSSQLRRSWRNASRIS, (SEQIDNO:4107); XM_005628367.2, MKLN1, Del, A_9, KPRLPWNIPC, (SEQIDNO:4108); XM_014111547.1, AP3B1, Del, A_9, KQRKIEILPKMFHF, (SEQIDNO: 4109); XM_014121826.1, LOC106560105, Del, A_9, KRGGGMYYFISQVAFRLSSIQMCRRCF, (SEQIDNO: 4110); XM_005630347.2, CEBPZ, Del, A_9, KRKEISVTPVYLYLLKSLATYWMKIWDPSLITLA, (SEQIDNO:4111); XM_014118195.1, AK9, Del, A_9, KRKKQQEKPLKRH, (SEQIDNO:4112); XM_014119443.1, BENDS, Del, A_9, KRKMRSLSHPSRLTN, (SEQIDNO:4113); XM_014112182.1, AHI1, Del, A_9, KRKRRLNQFLIIMKTLMVMVFMK, (SEQIDNO:4114); XM_014114026.1, FUK, Del, A_9, KRMCSGGRWPGGRAATSMGLGSVLVSLQLTSLMAATAT, (SEQIDNO: 4115); XM_533327.6, DDX18, Del, A_9, KRRREREKWWMMLGLIPKNQKLKTKGTLKKGPRLLKRQKTMGRSQMMRKRTVK CPAYPWD, (SEQIDNO:4117); XM_014119810.1, KMT2C, Del, A_9, KRSKRTKLWFLLINILHGKNLWVLVR, (SEQIDNO:4118); XM 005637736.2, TCF7L2, Del, A_9, KSAFATYKVKAAASVHPLQMEAY, (SEQIDNO:4119); XM_539422.5, SAMD9L, Del, A_9, KSKTSCVV, (SEQIDNO:4120); XM_014108379.1, BCL2L13, Ins, A-9, KSLQASDISGISGMYSGDHSSCQRLE, (SEQIDNO:4121); XM_005619458.1, EMB, Ins, A_9, KSMCYHTVEKHQILLLFYVRT, (SEQIDNO:4122); XM_014110679.1, SP3, Ins, A_9, KSPDRSGRVRRRFPHPLPPPPPSLLTM, (SEQIDNO:4123); XM_014119579.1, UHRF1BP1L, Del, A_9, KSQVIQCCLPVKSMI, (SEQIDNO:4124); XM_545992.5, WDR36, Del, A_9, KSSGKDFRMPCQ, (SEQIDNO:4125); NM_001003300.2, KCNMA1, Del, A_9, KSSGTEACGTHPAPRPS, (SEQIDNO:4126); XM_014118880.1, LOC482344, Del, A_9, KSTQFLCVL, (SEQIDNO:4127); NM_001286956.1, HGS, Del, A_9, KSTTRIPMWPCTPWRSWSLW, (SEQIDNO:4128); NM_001197174.1, ABCC4, Del, A_9, KSVRNLPTALC, (SEQIDNO:4129); XM_005631118.2, EHF, Ins, A_9, KSWLLAR1A1, (SEQIDNO:4130); XM_542898.4, FERMT1, Del, A_9, KTKVTRSP, (SEQIDNO:4131); NM_001003057.1, TCOF1, Del, A_9, KTRKKRKRRRQKRPQPKTLTHYSRRKRRKRRRQQSKLS, (SEQIDNO:4132); XM_532542.5, EXO5, Del, A_9, KTVFKSAYTNISLMPWFKGK, (SEQIDNO:4133); NM_001006950.1, IL5, Ins, A_9, KVCRRKMESDKVPRLPASISWCNKHRVDTGK1, (SEQIDNO: 4134); XM_014112285.1, NIPA2, Del, A_9, KVFCDLPRRAP, (SEQIDNO:4135); XM_014111124.1, SGOL2, Del, A_9, KVFMTQKKVTSFL, (SEQIDNO:4136); XM_014117699.1, RAPGEF6, Del, A_9, KVIAIQSRMYREILNTHHRRKEIRK, (SEQIDNO:4137); XM_003639290.3, SPAG9, Ins, A_9, KVKHLAIFQPTFQLLK, (SEQIDNO:4138); XM_014118133.1, ZNF292, Del, A_9, KVLKKQKAPCK, (SEQIDNO:4139); XM_005637736.2, TCF7L2, Ins, A_9, KVRSLHTR, (SEQIDNO:4140); XM_014115152.1, AXDND1, Ins, A_9, KVTDKGRKRTPTWRRGFC, (SEQIDNO:4141); XM_005633512.2, POLD3, Del, A_9, KVTGGSEWSYLMMKQKKLKI, (SEQIDNO:4142); XM_535048.6, ACADSB, Del, A_9, KWESEPLPPVH, (SEQIDNO:4143); XM_850840.5, VPS13B, Del, A_9, KWIHLMEAWLKPHLGTVVPRIVELAVTVLKSE, (SEQIDNO:4144); XM_014112849.1, RUFY2, Del, A_9, KWLITCVA, (SEQIDNO:4145); XM_014110905.1, LOC106558304, Ins, A_9, KWWWRRVYGKTPRGLDETLQIWPPGGRS, (SEQIDNO:4146); XM_014119214.1, FAM221A, Del, A_9, KYYRCAYRTGYL, (SEQIDNO:4147); XM_014111124.1, SGOL2, Ins, A_9, MYFTVTRFFTDICLLRIRFKIYY, (SEQIDNO:4148); XM_005615403.2, RNMT, Del, A_9, NAISLFWTWDVVKVEICSNGKREELTS, (SEQIDNO:4149); XM_005636978.2, KIF21A, Ins, A_9, NARAFPYNQEKSI, (SEQIDNO:4150); XM_005633326.2, CEP57, Ins, A_9, NARVGSKTPGRTTGKETYAS, (SEQIDNO:4151); XM_014107150.1, SYCP2, Ins, A_9, NERKVKRERIY, (SEQIDNO:4152); XM_014115615.1, LOC100682643, Ins, A_9, NFLHLCLPSHCGLYLLWHHYLCLCSPSSEAQLHHW, (SEQIDNO:4153); XM_005619222.2, SPDL1, Ins, A_9, NGGRCNCRSSMQTQRG, (SEQIDNO:4154); XM_535048.6, ACADSB, Ins, A_9, NGNPSLFHLCINI, (SEQIDNO:4155); XM_014111562.1, GLRA4, Ins, A_9, NHAETLCGPSQAD, (SEQIDNO:4156); XM_005622315.2, CD55, Del, A_9, NHVLILEI, (SEQIDNO:4157); XM_535332.5, ZCCHC17, Del, A_9, NIETGSHLTLTAQTLRVTQARGQGTHQKTARQQRRRRRRRSIRRNTRS, (SEQIDNO:4158); XM_014116983.1, TTF1, Del, A_9, NIGGKRLPVMLSRRAHLLGSPCPSRVRIRRSWKACFLWAQRAESHNYQ, (SEQIDNO:4159); XM_005635025.2, RBL1, Ins, A_9, NIICTFYPTDRTAIFTRKRSSHYSCCFSYSKCEPITEYCGWTEKCTK, (SEQIDNO:4160); XM_532882.5, SMC6, Ins, A_9, NILVKRESKGLAGSRKLNQSRD, (SEQIDNO:4162); XM_014112539.1, RGS12, Del, A_9, NIRKLIWTKQRSFLSSFPKLRATEQTTSAGC, (SEQIDNO:4163); XM_532047.5, CNTR1, Ins, A_9, NKCSTNSTIRTT, (SEQIDNO:4164); XM_014114329.1, IQCE, Ins, A_9, NKFDGKPQITCFRSGQGKRCGALCVQLHCVQAATR, (SEQIDNO:4165); XM_005635474.2, PDSSB, Del, A_9, NLDLQHQKKRKKKKDKVETQNRSQRANSTEHQGEHNRAEQNLLKLVQLNPHNPHHRKDEEDHQKRHHHHNQKKMSV, (SEQIDNO:4166); XM_005635476.2, PDS5B, Del, A_9, NLDLQHQKKRKKKKDKVETQNRSQRANSTEHQGEHNRAV, (SEQIDNO:4167); XM_005635475.2, PDS5B, Del, A_9, NLDLQHQKKRKKKKDKVETQNRSQRANSTEHQGEHNREQNLLKLVQLNPHNPHHRKDEEDHQKRHHHHNQKKMSV, (SEQIDNO:4168); XM_005629758.2, PSD3, Del, A_9, NLHQKVLMRRLMEHIQRPSVVSGALPIHS, (SEQIDNO:4169); XM_005639368.1, LOC100856070, Del, A_9, NLMKVGNK, (SEQIDNO:4170); XM_005641429.2, OPHN1, Del, A_9, NLRRMVRGFIPCWIGTYNLPKRKNLSYKRQTSRWTRKGTISLSPLLIMFIKFRKFRSP RSSTLWSQCWPFFIASSFPTV, (SEQIDNO:4171); XM_014120849.1, NME8, Del, A_9, NLTFKILSFL, (SEQIDNO:4172); XM_014113911.1, RERE, Del, A_9, NLVMKGQTLGR, (SEQIDNO:4173); XM_005617803.2, STPG1, Del, A_9, NPAMPTNYREVLLPHIQHNPPFLLKARLQQF, (SEQIDNO:4175); XM_005639444.1, CRYBG3, Ins, A_9, NPRAWWRGCWRNGERSP, (SEQIDNO:4176); XM_014112201.1, CAST, Ins, A_9, NPRSKAKGTQRAKKPTQACIRYGKQACS, (SEQIDNO:4177); XM_005628367.2, MKLN1, Ins, A_9, NQDCPGTSHVNRST, (SEQIDNO:4178); XM_014118880.1, LOC482344, Ins, A_9, NQLSSSVFYE, (SEQIDNO:4179); XM_545547.4, PLEKHA3, Del, A_9, NQTLKILFHPSLP, (SEQIDNO:4180); XM_005640421.1, AOX4, Ins, A_9, NRARKCRAS1, (SEQIDNO:4181); XM_005629522.2, TPK1, Ins, A_9, NRRKRPTGRRNCDLGRSCRAF, (SEQIDNO:4182); XM_014113418.1, TBC1D32, Ins, A_9, NSEGEKQQQLLHR, (SEQIDNO:4183); XM_005626122.2, PAPOLG, Del, A_9, NSFITTFQQRFFKRRKSKVFLMLVEVQVDLNPKDH1, (SEQIDNO:4184); XM_014116072.1, MLH3, Del, A_9, NSMVEEQTFLVMDKLNYVP1A1, (SEQIDNO:4185); XM_005627548.1, MYO6, Del, A_9, NSRKRKQKG, (SEQIDNO:4186); XM_003432384.3, LOC100686139, Ins, A_9, NSRSKSHFDDGIYSFGIF, (SEQIDNO:4187); XM_532047.5, CNTR1, Ins, A_9, NSTCTHKAGN, (SEQIDNO:4188); XM_848625.3, ABCA9, Ins, A_9, NSVDHIIAFWH, (SEQIDNO:4189); XM_014117774.1, RFX3, Ins, A_9, NSYHGTLYKQTSEFW, (SEQIDNO:4190); XM_014110705.1, GRB14, Del, A_9, NTEHRLTMDSALSLTKREGPET, (SEQIDNO:4191); XM_014113145.1, SPEF2, Ins, A_9, NTNTHIGC, (SEQIDNO:4192); XM_014111124.1, SGOL2, Del, A_9, NVFHSYQILYRHLSP, (SEQIDNO:4193); XM_014112778.1, LOC106558676, Ins, A-9, NVFVLFSEHLWSSSARHCSKLWGRGQKSELPARGSGPSRKK, (SEQIDNO:4194); XM_549109.5, RPS6KA6, Del, A_9, NVSQNKKLVMY, (SEQIDNO:4195); XM_850174.2, LOC612447, Ins, A_9, NWKETEWKE, (SEQIDNO:4196); XM_847826.3, SGOL1, Del, A_9, NWMNLSLPMMLTILIW, (SEQIDNO:4197); XM_005623826.2, MOK, Ins, A_9, NYALYVPVM, (SEQIDNO:4198); XM_014106333.1, ERCC5, Del, A_9, NYASCSSHLAFPIQLLRMLTSNLWWMIPGDRFCGGNQIWTKLENFVSVILAGTGRRQ MSLCFQY, (SEQIDNO:4199); XM_005634067.2, ERCC5, Del, A_9, NYASCSSHLAFPIQLLRMLTSNLWWMIPGDRFCGGNQIWTKLETLFWLEQDEDR (SEQIDNO:4200); XM_014119410.1, SYCP3, Ins, A_9, NYDGDCKSLHFKLEK, (SEQIDNO:4201); XM_014120966.1, ZNF236, Ins, A_9, NYKEEVTISAWFNP, (SEQIDNO:4202); XM_005624937.2, SMYD4, Del, A_9, NYKKRGHFS, (SEQIDNO:4203); XM_014118195.1, AK9, Ins, A_9, RGRSSKKSH, (SEQIDNO:4204); XM_014110977.1, NBEAL1, Ins, A_9, RKGIGRSDIY, (SEQIDNO:4205); XM_005624758.2, BCAS3, Ins, A_9, RKKKTMPTAQRP, (SEQIDNO:4206); XM_005617448.2, NLN, Ins, A_9, RNNESRGWNEIQKPNPETWGISGRHGHAPEFLET, (SEQIDNO:4207); XM_014108747.1, NLN, Ins, A_9, RNNESRGWNEIQKPNPETWGISGRHGHAPEFLETSEHRVLV, (SEQIDNO:4208); XM_532542.5, EXO5, Ins, A_9, RPFSSQPIQNL, (SEQIDNO:4209); NM_001003057.1, TCOF1, Ins, A_9, RQGKKGKEEEGKKGLNQRP, (SEQIDNO:4210); XM_863127.3, ZFR Ins, A_9, RSRIESFTKYQQQQQFYSWDSKSATI, (SEQIDNO:4211); XM_014112285.1, NIPA2, Ins, A_9, RSSATCQEGLHESRSRWPCIS, (SEQIDNO:4212); XM_536157.5, NIPA2, Ins, A_9, RSSATCQEGLHESSGSR, (SEQIDNO:4213); XM_014112649.1, RBPJ, Ins, A_9, RTNGTGWLF, (SEQIDNO:4214); XM_005619174.2, UIMC1, Ins, A_9, RVWGTSVT, (SEQIDNO:4215); XM_014119214.1, FAM221A, Ins, A_9, SITDALTEQVICELAITDWNGL, (SEQIDNO:4216); XM_863127.3, ZFR Ins, A_9, SKSR- FASRSKAQYSSQKDSRRENEEADAERRV-LAKTRRRRTLENGNEAL, (SEQIDNO:4217); XM_545992.5, WDR36, Ins, A_9, SQAERTSECHVSE-ASTHHKVCS, (SEQIDNO:4218); XM_005638661.2, SCAPER Ins, A_9, SQKDKSPDELQSQGI, (SEQIDNO: 4219); XM_539422.5, SAMD9L, Ins, A_9, SQRPPVSSNWSG, (SEQIDNO:4220); NM_001286956.1, HGS, Ins, A_9, SQRQESPCGLVRPGGHGVCGEELWPD-GARRGGQQADHGGA, (SEQIDNO:4221); XM_848625.3, ABCA9, Ins, A_9, SSLTATDFRPLPFCLL-VWPGTGGYSTLLLDPPSNANNGLCF, (SEQIDNO: 4222); XM_014113182.1, JAK1, Ins, A_9, SSRCYPSS, (SEQIDNO:4223); XM_005617981.2, PRDM2, Ins, A_9, SVAFIQERWTRVTCRQ, (SEQIDNO:4224); XM_005622165.2, LOC100682872, Ins, A_9, TADHRD-FLSSTSPWQLPLGHPAISLLCFLLI, (SEQIDNO:4225); XM_005627548.1, MYO6, Ins, A_9, TAGRGSRKAEAY-SRRNGKRKKKT, (SEQIDNO:4226); XM_005626122.2, PAPOLG, Ins, A_9, TASSLPSSRDSSKEEKAKSF, (SEQIDNO:4227); XM_014106376.1, RBM26, Ins, A_9, TGGTETSARCKEKETRNFRKAH, (SEQIDNO:4228); XM_014120722.1, SYCP1, Ins, A_9, TKGCRKAICL, (SEQIDNO:4229); XM_005635545.2, SACS, Ins, A_9, TLSFQSIECSCLKCFKRSC, (SEQIDNO:4230); XM_005636132.2, MPHOSPH9, Ins, A_9, TNRDFRYTN-HESFKRT, (SEQIDNO:4231); XM_851972.4, ARV1, Ins, A_9, TQLHFAAESIIIIQLWKALAHSSCHLGA, (SEQIDNO:4233); XM_005615403.2, RNMT, Ins, A_9, TRYHCFGPGMW, (SEQIDNO:4234); XM_014116983.1, TTF1, Ins, A_9, TSEERGFL, (SEQIDNO:4235); XM_005624937.2, SMYD4, Ins, A_9, TTRKEAIFPENFGRKGLDWTSQST, (SEQIDNO:4236); XM_005621019.2, ACTB, Ins, C_10, HRRVPLVATP, (SEQIDNO:4237); XM_003435344.2, DPH7, Del, C_10, PAALTGDFSPHPDRDPRSHRGPQLPHRPYSHRRPQPP-PRPPLSTWPLHPAFAALSPLR LRLTPG, (SEQIDNO: 4238); XM_014116284.1, WNK2, Ins, C_10, PAPSLV-PEPRARRPARPARPGTGQQQQQQEGHLHG, (SEQIDNO:4243); XM_014116598.1, SIX5, Ins, C_10, PCCPPAPPSPPPSSPAGPRPRGAAPGVCGRGRGG, (SEQIDNO:4245); XM_014121371.1, LOC106560024, Ins, C_10, PCGGAPRPAAATGEKRDTDGL-PRAWGLRRPVNTGMGAASAHGARGGRRRGRQGQ PGQRPSAPITAGAASWPRVRPRQEPP, (SEQIDNO: 4246); XM_014114858.1, TRIM28, Ins, C_10, PEPAWCWPECPGAIQWSW, (SEQIDNO:4248); XM_014110311.1, SLC9A3, Del, C_10, PGGPILIGNS-SAKSL, (SEQIDNO:4249); XM_014115712.1, SLC25A29, Ins, C_10, PGPGGPHTRRGCGRRACGTPI, (SEQIDNO:4250); XM_014115712.1, SLC25A29, Del, C_10, PGTGRAPHAA WVWQACLWDTHLTRSRCGCR-CRARRSLSTGGPCTASSPSSSRRACWACTRAWARR SWGSRSSTRWCSACRATPCGRWAATRR, (SEQIDNO: 4251); XM_005620616.2, HSF4, Del, C_I0, PHCPWLWCRPSWKGRGTSAP-RGPGMPNSLNQGVPGRYLTGGLWAWTGGHEAQRI CCLPCCFGP PLKVWSLQGPWMCWAPAIKGENGP, (SEQIDNO:4252); XM_542531.4, DBX1, Del, C_10, PHSPSLHASPLRRAPTPAGVGVGAPPRFPQKKKTR-TRT, (SEQIDNO:4253); XM_014117361.1, LOC106557479, Ins, C_10, PKASWREWLCADPGG-WARCPREECPVAHRSQKTGHVPGPLPQQRPRTP, (SEQIDNO:4254); XM_005640409.1, HOXD8, Del, C_10, PLLGILGLGRRLPPAAGLPVTGSPRSFTDTI-TYRDSRFLRPSKRPSWYNILTVNRPVVI LARTQTT, (SEQIDNO:4255); XM_014116598.1, SIX5, Ins, C_10, PLLPPGPSIPAPLLPCRTPT-PRGCSWGLRQGARRMRGWRPSRRF, (SEQIDNO: 4256); XM_014108684.1, LOC106557920, Ins, C_10, PLPHPAGSNSRGCSESC, (SEQIDNO:4257); XM_014121371.1, LOC106560024, Del, C_10, PLRRRPQARSSDR, (SEQIDNO:4258); XM_014108317.1, LOC106557878, Ins, C_10, PLT-SPPPFSPCSQYFI, (SEQIDNO:4259); XM_014112775.1, PPIF, Ins, C_10, PPAPDSQAEGRCRPKDGREL-QSPVYRGEGLRLQRF, (SEQIDNO:4260); XM_003435344.2, DPH7, Ins, C_10, PPLSPAISAPTRTAT-PALTADPSSHTDPTLTADLSPHPDPRFQPGL-STPPSPPCLRCVCV, (SEQIDNO:4261); XM_014114444.1, BAIAP3, Ins, C_10, PPPAQLEQLAR-RAQRARGHRALPPRRAEQPVCAAAGGAAL-GGEQPSPSDLHAGLRL PAGAAGGHAGTLGGGVLPA-PRAGEEPG, (SEQIDNO:4262); XM_005621019.2, ACTB, Del, C_10, PPQSPPRGHPLKLSPASVSSQAWN-PAASMKLPSTPS, (SEQIDNO:4263); XM_014117361.1, LOC106557479, Del, C_10, PQGFVEGVA1C, (SEQIDNO: 4264); XM_005637736.2, TCF7L2, Del, C_10, PQTP-SHRLSRPSRCRCP, (SEQIDNO:4265); XM_014116284.1, WNK2, Del, C_10, PRPLPGPRAPSQAPSPPCTSRHRPT-TATTRGAPSRMTCTSWWTSGRARRRGPPS, (SEQIDNO:4266); XM_014113226.1, CXCL16, Del, C_10, PRRDPAPVGGSRTFPRFSPGM, (SEQIDNO:4267); XM_014118733.1, GLI4, Del, C_10, PRRPHGPRTTPPGRPAPAAWCPGAAQAGGLP, (SEQIDNO:4268); XM_014122165.1, CBARP, Ins, C_10, PRRRGPQGQPRHIPAPGEGPHRPLRGPQLRPAR, (SEQIDNO:4269); XM_014116598.1, SIX5, Ins, C_10, PRVPPPALPPWTSDPTLLGHISAPPTPTRAPRTQTAR-SPPPPPTPPPCCPPAPPSPPPSSP AGPRPR-GAAPGVCGRGRGG, (SEQIDNO:4270); XM_005637965.1, PXDNL, Del, C_10, PSAR-GRSRAAAAAAAAS, (SEQIDNO:4271); XM_014109368.1, LOC106558038, Del, C_10, PSGLVPWGGPRHAAPLRVWGLLF, (SEQIDNO:4272); XM_014112775.1, PPIF, Del, C_10, PSGSRLTS, (SEQIDNO:4273); XM_005640409.1, HOXD8, Ins, C_10, PSSASSASAAASPLRRDCLSRGAREVLRIR, (SEQIDNO:4274); XM_014108684.1, LOC106557920, Del, C_10, PTAPSRGIQLPRLQRVLLTRPPRP-PRPPGSHSPREQAEPVGAQGRCSLATCRQALG, (SEQIDNO:4275); XM_014116598.1, SIX5, Del, C_10, PTGSPPRAAPLDK, (SEQIDNO:4276); XM_005620616.2, HSF4, Ins, C_10, PTVRGCGAGHPGREGELQPRGAQECPTA, (SEQIDNO: 4277); XM_545337.5, LOC488215, Ins, C_10, RPRGSEKHELLEVLPFRSRPAQRAHPADG-LSQPVAPAAELGEAEWPRPEAREAARLR GRPRREGG FPVGQHLAVARGQRP1, (SEQIDNO:4280); XM_543674.5, SMARCD1, Ins, C_11, PASRAVPLP-DARSGLSETRHAAR-QPNDTSGTFHGTPWLWGEPFSPTWPGPVRDGPVP QETCTSADTAGPAAGGPKSKPQCKEKEDG, (SEQIDNO:4283); XM_014108583.1, ARID2, Ins, C_11, PEPADVAVRNSF, (SEQIDNO:4285); XM_014113969.1, LOC106558847, Del, C_11, PGARSRGRGPLRRARSG-GRSGPAAVSSPHGPRRA-PRAAAQAPAAAGQQPQQLPGAQG YAGARPSLPR-TRAP, (SEQIDNO:4286); XM_005639618.2, LOC102153772, Ins, C_11, PGPPAGGGARPEGGD, (SEQIDNO:4289); XM_850394.4, ST6GALNAC5, Del, C_11, PGPRPRPPPPRRGRWTDTSA, (SEQIDNO:4290); XM_014108583.1, ARID2, Del, C_11, PGTRRRRCPEQFLRRISGEKLLKSSTFPEVVLTLPLL, (SEQIDNO:4291); NM_001205203.1, MEF2B, Del, C_11, PGVLPPGPPN, (SEQIDNO:4292); XM_547695.5, ZBTB7C, Del, C_11, PHHPPSPATSSRTCSPTSLGGR-WAPSRPRVTTVPISTS, (SEQIDNO:4293); XM_014110530.1, LOC106558242, Del, C_11, PHPHLAPSLVPHPYSGPPH, (SEQIDNO:4294); XM_014118871.1, LOC106559658, Ins, C_11, PHTH-TQRLPLPFLLAPKYGLWTQAPGARPQGGIL-GLEKETHTRDSLPPTCPPERGK, (SEQIDNO:4295); XM_005627791.2, TSPYL1, Del, C_11, PLAKAWQRRR-CRCRWQRTAAWKMGVGAPGRAGRVRGALRGRRT-CGRRRRPRSC RPATASLRRRRRRRRRRSPGWRQTR-REGKSWPGGRVPGRPRGPDA, (SEQIDNO:4296); XM_014120240.1, MTA3, Del, C_11, PLRPP-SQLQHRLPELKRSPLGLLRANCPALRSKPREGVP-GAGIILNYYQQFTRHPTPA AQPAPCPPEAKQIMSTL-RIPPVTRT, (SEQIDNO:4297); XM_005634658.1, LOC102156928, Ins, C_11, PQCPTPRCAHRPQSSRPR-SAPPPRSARRPQGPTPRI, (SEQIDNO:4298); XM_543674.5, SMARCD1, Del, C_11, PRLKGCTAPRCPERPIRDQACCQAAE, (SEQIDNO: 4300); XM_005639644.1, LOC102151137, Del, C_11, PRPRPAAGAHSGPGRHTPG, (SEQIDNO:4301); XM_014114924.1, LOC607201, Ins, C-11, PSLELLGQELWGPWSCAGQGAPSVPGSQQAVL-CRAALLATTTLW, (SEQIDNO:4302); XM_014115040.1, SH2D2A, Del, C_11, PSPPIPSTRSPTSPSPSTPWG-GAAPGKPRATSMRRWRWRSRLGPGGP-PASSGTPGPCGN AGPGLSREARIQEPGDHSLRT1, (SEQIDNO:4303); XM_014113855.1, TPRGL1, Del, C_11, PSRVITSLLSSAHWLL, (SEQIDNO:4304); XM_005618215.1, LOC102151979, Del, C11, PTPQVPL-MAPLPLPRRC1, (SEQIDNO:4307); XM_547695.5, ZBTB7C, Ins, C_11, PTTPLPQRLLQGHVPRPPW-GAAGPHQGRE, (SEQIDNO:4308); XM_014115040.1, SH2D2A, Ins, C_11, QALPSHLPGARRAH-RLLRHGAGQPRGSPVQRLCGGGGGGPAWGRGAPLR-PRAPGP AEMPVQACPGKPESRSLATTV, (SEQIDNO:4309); XM_014113969.1, LOC106558847, Ins, C_11, REPGAEGGR, (SEQIDNO:4310); XM_014120240.1, MTA3, Ins, C_11, RSAPRASCSTGSRS, (SEQIDNO:4311); XM_005624453.2, HSD17B1, Ins, C_12, HYGSH-LAGARALAPRYRT-SALQLGGSGPRRLGDWPKVTRRGSPPGWGSDADLPHP HAAAGAGAGRGRGALRAVRRP1, (SEQIDNO:4312); XM_014106269.1, LOC102153036, Del, C_12, PAPSS-ESRLPGHRQAPQNSRGPSQRLRVAAPRP-PHGRCSFGLRWGFPWRPRLRGGHP, (SEQIDNO:4313); XM_014110359.1, LOC106558197, Del, C_12, PGPQVQMEGGGGLRPLHLRPQRGPARLDLGTSPAV-LTGRGWERRREEGKKGLGFR AAGHRKA, (SEQIDNO:4314); XM_845687.4, C1H9orf40, Ins, C_12, PGQQSAGGDRLPWLPPQPVGSQPAPRRGA, (SEQIDNO:4315); XM_005624453.2, HSD17B1, Del, C_12, PLRLTSGGCQGACPSLSHFCPAAGRLRPEEAG, (SEQIDNO:4316); XM_005634658.1, LOC102156928, Del, C_12, PQRPTPAGPDAPH, (SEQIDNO:4318); XM_014117451.1, LOC106559403, Ins, C_12, QNQAASKTFFPLPAASHTRRHPGGPAANGRRGGAR-PRPRRLLGSCTRRPPHGERGA ASSRGGAAS-PHPDRDRRFGIAKD, (SEQIDNO:4319); XM_014110359.1, LOC106558197, Ins, C_12, RGRR-CRWKGAAG, (SEQIDNO:4320); XM_005634658.1, LOC102156928, Ins, C_12, RSARRPQGPTPRI, (SEQIDNO:4321); XM_014106524.1, RBP1, Del, C_13, PGAGFWGPTALGTVLWI-FLPTLCPSVPRHPLQMLMWPCAKLPTC, (SEQIDNO:4323); XM_014111383.1, RBMIO, Ins, C_13, PMAPGRRQSRRPGWVSSRAPSFSLTPT-SAPFIPSLPQH, (SEQIDNO:4325); XM_532513.4, BMPER, Del, C_13, PPLPGARLPPARTVSRLAG, (SEQIDNO:4326); XM_014119800.1, LOC106559804, Del, C_13, PPRGRGVQD, (SEQIDNO:4327); XM_014118514.1, LOC106559608, Del, C_13, PRGCAPPPRSAQPGRAHPRDSPAGLRRAGGGVSSAR-PRARSAACPPGLSE, (SEQIDNO:4328); XM_005642274.1, LOC102152225, Ins, C_13, PRHSPRVCACVPR, (SEQIDNO:4329); XM_014118307.1, LOC100685196, Del, C_13, PRPC-CLRGPWP, (SEQIDNO:4330); XM_005642274.1, LOC102152225, Del, C_13, PTPLTPCVCVCAA-LAAGWLSGPPPAPEPSRRRRWLGGRVWVGPA-PAWGRLPGS, (SEQIDNO:4331); XM_014106524.1, RBPI, Ins, C_13, QELASGAPLP, (SEQIDNO:4332); XM_014119800.1, LOC106559804, Ins, C_13, RPAAGAY-RISCC, (SEQIDNO:4333); XM_014115020.1, INTS3, Ins, C_14, PAMPPWNGHSRCQSVY, (SEQIDNO:4335); XM_014116506.1, SPATA32, Ins, C_14, PGRQGRN-RAGDITGAGAPSISGAPQSPQPKSALEAEGQQP-PARSLPP, (SEQIDNO:4336); XM_014112078.1, LOC102152371, Ins, C_14, PPGEPL-SPHQDPRRLLLLRVRRH-PAQELLRGDGPGHDRYHHVGGRGH, (SEQIDNO:4337); XM_005638993.2, LOC102152474, Del, C_14, PPPGCLRDAEGHSGRPGPGTGNAGLAICTLKPGR-GARGMELARRWSPPRPTLQKAR QARTAWTEG, (SEQIDNO:4338); XM_005637886.1, NSMCE4A, Del, C_14, PPRRGPGDPGLAALLQVITPARTCSRVM-STFPQTLFFVCLVFCFFFFA, (SEQIDNO:4339); XM_014115020.1, INTS3, Del, C_14, PRHAALEWPQSLSECLLSPVWYAKAPHSMRKSA-WASSPSSSLNLPKLKSVTGTWLW (SEQIDNO:4340); XM_014112078.1, LOC102152371, Del, C_14, PSRRTTVAASRSSATVITACPASPSPRTAAWRWAWT, (SEQIDNO:4341); XM_005640730.1, LOC102154007, Ins, C_14, PVVQGRGSHPRHPGP, (SEQIDNO:4342); XM_005637886.1, NSMCE4A, Ins, C_14, RPAGDPGTRAWPRCCR, (SEQIDNO:4343); XM_005638993.2, LOC102152474, Ins, C_14, RPRGVSGMRRVTPGGLGLGLATRASQSAP, (SEQIDNO:4344); XM_014106492.1, VIL1, Ins, C_15, PANT-CALGSPEPEGHSGGIQRPALLGGEGGGRGGAGLG-GRLRAAPAGGAGRGRRAA PGGAGPRVPLFPQLLPPGRPLQERWPELCPQA, (SEQIDNO:4345); XM_847492.2, CCBE1, Ins, C_15, PARGPAPADPAALAPGPPLPRGRPAKWPPRLSS, (SEQIDNO:4346); XM_014116208.1, ITGB4, Ins, C_15, PDSRVCEPVSNHQWHPQYPGGPVVLPD1, (SEQIDNO:4347); XM_005640152.1, IRF4, Ins, C_15, PDTRSRGPSPASPAAPGPRQQRPLAPTRVAPRCPPS-SAPGSAPAGF, (SEQIDNO:4348); XM_005615674.1, LOC102154183, Ins, C_15, PQDPL-HAPPGGQQLQSGAAPPSGPPADGAAGSSAGHPPAR-RAHLRRRGPARP, (SEQIDNO:4349); XM_005640152.1, IRF4, Del, C_15, PRHALPRPEPGLPRGAGSPPAAP-PRPDPGRAALPAQLRPRLRPSGLLSFISSSFPPRHLL GFTS, (SEQIDNO:4350); XM_014106492.1, VIL1, Del, C_15, PRKHLCFRFPGA, (SEQIDNO:4351); XM_847492.2, CCBE1, Del, C_15, PRPGTRARRPRR-PRARPSAPPRPPRQVAAAPVVLGSSARRTR-SPRPGTRV, (SEQIDNO:4352); XM_005639335.1, CYP2U1, Ins, C_15, PVLPAASASRTCKLCALHPRRP-PASGREKGSLPPPHPPLAAGTLGAGVQGESLRGHP GHEEPGSQSVSPAPRPDARAPR-PARRGPQLRGCERRPGPLGRS, (SEQIDNO:4353);

XM_014116368.1, GOSR2, Del, C_16, PAFILIWFILK-TIVMECLVWAGP, (SEQIDNO:4354); XM_014116598.1, SIX5, Del, C_16, PHPPPLLPPGPSIPAPLLPCRTPT-PRGCSWGLRQGARRMRGWRPSRRF, (SEQIDNO: 4355); XM_014116598.1, SIX5, Ins, C_16, PTPPPCCP-PAPPSPPPSSPAGPRPRGAAPGVCGRGRGG, (SEQIDNO:4356); XM_005639009.1, POFUT2, Del, C_17, PGISCTTSTPRRASTSAGMSTSASPPS, (SEQIDNO:4357); XM_014119273.1, LOC106559736, Del, C_17, PLWSIRLRW, (SEQIDNO:4358); XM_014119802.1, LOC482696, Del, C_17, PRTRWQAFGRQLRNIEQRVCSWTLSLLLMGFPT, (SEQIDNO:4359); XM_005639009.1, POFUT2, Ins, C_17, QVSPVRRQPPGGLQPPQGC1HPRRLPPEDAAADRG-VGAGAAP1GPPLSLAEPRHPPG PDSLVRLF, (SEQIDNO:4360); XM_014119802.1, LOC482696, Ins, C_17, REHAGRLLAGS, (SEQIDNO:4361); XM_014106854.1, LOC106557662, Del, C_22, PRQDPGRPR, (SEQIDNO: 4362); XM_014106854.1, LOC106557662, Ins, C_22, RGRTPGARV, (SEQIDNO:4363); XM_014116429.1, SHISA7, Ins, C_7, HAAARAAPTARPARAPPPRPARL-PAAGLDVGRRWGRGHAGAQAALPAPGHAGATA VHPRPPPSATPAHRQQE, (SEQIDNO:4364); XM_014106282.1, STK24, Ins, C_7, HAGRNLQQTPQGIC, (SEQIDNO:4365); XM_014116613.1, SRCIN1, Ins, C_7, HAPP-PADPHLAGTPGPGAPSGLSPGPHMEERWWQRATH-EGGDSRGLSAEGGPGPGR QPRQRQAWQAE-GRVHEDPGPAAGH, (SEQIDNO:4367); XM_014116610.1, SRCIN1, Ins, C_7, HAPP-PADPHLAGTPGPGAPSGLSPGPH-MEGCPKPQGLLRPPDHLDRVYPQPSLTTRG QTRGSWSQDNSHSAPPDPAWQWEGL, (SEQIDNO: 4368); XM_014113911.1, RERE, Ins, C_7, HCGPPPFCFFPPGPEPPGEGETGPGGPPAAA, (SEQIDNO:4370); XM_843373.4, AGAP1, Ins, C_7, HCQHAHTCPEAVQAPLQPFHLSERE, (SEQIDNO: 4371); XM_014121818.1, LOC476718, Ins, C_7, HDCVHIPGLARSGCQPSHLPWPPPGLPPR-SQEPCPGTPSSDTPTHPPAREGWGSHWS RCHLHPPP, (SEQIDNO:4372); XM_014116831.1, ABR, Ins, C_7, HFLRRTEAEHTVLLH, (SEQIDNO:4373); XM_003433467.3, TARBP2, Ins, C_7, HGGAAPRLPSAV, (SEQIDNO:4374); XM_014114672.1, HCFC1R1, Ins, C_7, HGIPPISAPTQEPV1, (SEQIDNO:4375); XM_014121831.1, TLE6, Ins, C_7, HGLPQPPQLPR-GLPGRERRAGHRS, (SEQIDNO:4376); XM_533913.5, RAB3D, Ins, C_7, HGPAGCSRPEL, (SEQIDNO:4377); XM_014116695.1, BZRAP1, Ins, C_7, HGRGDQGLARGWWERAAAPFPEMLPWPGPRI, (SEQIDNO:4379); XM_014117075.1, DENND1A, Ins, C_7, HGRPFSDPNVAPGPLKCQGC, (SEQIDNO:4380); XM_014107665.1, HDAC4, Ins, C_7, HGRRGVLGSLQDRGHAHRERVCPRRGARVIRL, (SEQIDNO:4381); XM_014119061.1, IRF5, Ins, C_7, HGTLFFTQRGCQV AAHPPAACGAGPSC-TRPQPAGPHPWQPCWLWGASP, (SEQIDNO:4382); XM_014118376.1, GRM4, Ins, C_7, HHHQT-GTCGRCHRCFRELCLHHGGQHPSPLQDPPDQLRLH-SPRPE, (SEQIDNO:4383); XM_005630266.2, NRBP1, Ins, C_7, HHPWEPD1, (SEQIDNO:4384); XM_003431507.2, TOM1, Ins, C_7, HHRAR-QGAQPHPVLG, (SEQIDNO:4385); NM_001013847.1, TPP1, Ins, C_7, HIIPEATP, (SEQIDNO:4387); XM_014109477.1, STARD9, Ins, C_7, HKAALWLGKS, (SEQIDNO:4388); XM_546428.4, VSIG2, Ins, C_7, HKRGGHPETD, (SEQIDNO:4389); XM_844789.4, CBX6, Ins, C_7, HLAFLRDGAHHQSQGQASGAQAK-PHHPQPEGDRQGHRRGRPRAGGRSPRSPQSPLQ EPRHWQEQEVQREHPAHPDPPHEVWHLLAVQ, (SEQIDNO:4390); XM_005627318.2, FOXP4, Ins, C_7, HLGCCSCHPPSAPWPQLCLPAQWRPCPPEEQ, (SEQIDNO:4391); XM_014121836.1, LOC106560107, Ins, C_7, HLPEPPLLRPRQQQPGSG, (SEQIDNO:4393); NM_001287125.1, CDH1, Ins, C_7, HLQPNHVPGTGA, (SEQIDNO:4394); XM_843371.3, LOC606890, Ins, C_7, HLRDAQGRARGGGPRGGAPERSSRYHHRDQHPR, (SEQIDNO:4395); XM_014118383.1, UHRF1BP1, Ins, C_7, HLSNISRPYPHHSSHGAYCVEAE, (SEQIDNO: 4396); XM_546572.6, CAMTA2, Ins, C_7, HLSRGFIQR-RHRNPPPDGTGAACGGLDAHQALGSPD, (SEQIDNO: 4397); XM_843636.3, CDSN, Ins, C_7, HNLCRQILWQL, (SEQIDNO:4398); XM_014108022.1, LRRC43, Ins, C_7, HPARAGQWPAGLGA-PAGGGVTCVLRVQLWGDPHPGNRQADVS, (SEQIDNO:4399); XM_544410.5, SALLI, Ins, C_7, HPATSE-QFRPHHRSTQQRLFPQH, (SEQIDNO:4400); XM_005640913.1, LOC488620, Ins, C_7, HPGGRLLP-PAIRRALPGHDGVLPAGRHGSGPPPGHLPPAALPRA-HEQEGAAGAGGG RLGGRLLGGPGASRPHGR-PALLPEAGGPLLL, (SEQIDNO:4401); XM_014112353.1, LOC106558589, Ins, C_7, HPGLSRAPR-GRRLSGAARPEVAPDGPGTLSGRPRRV, (SEQIDNO: 4403); XM_005633500.2, NEU3, Ins, C_7, HPHLPGLC-REALHEQG, (SEQIDNO:4404); XM_538306.5, KLHDC7B, Ins, C_7, HPLPPIPWQGP, (SEQIDNO:4405); XM_005630809.2, POGZ, Ins, C_7, HPLPRGPPAP1GKKIHPKSLEPEGGFLSPAGRRALHG-SLSAVSPSPRPLPCSHPLLPAP GARSL, (SEQIDNO: 4406); XM_544055.4, HMX2, Ins, C_7, HPLSLPGYPQGRRRRGAGELGAHAFPLCFAPGL, (SEQIDNO:4407); XM_014121373.1, LOC106560025, Ins, C_7, HPPAAPGLPP, (SEQIDNO:4408); XM_005618506.2, MFSD10, Ins, C_7, HPPADASGH-PRDHCGLPRPPAGPSGLHSATAPAARTAGEPQSCPRP-PLWLVAARCGL VCSSHQDAS-REEVQQRPVWRSDWLRLLLPAVPPGTTHGGS1, (SEQIDNO:4409); XM_014122263.1, SHC2, Ins, C_7, HPPGAHRPHGGAAAAGTLVPWPDE-PEGGREAAPSRRGLPGARQRH, (SEQIDNO:4410); XM_844754.4, PLEKHO1, Ins, C_7, HPP-SAPPGPAVPDPGPGSQETGKDSGAAGRGSGPGRRE-AEGQGPPLVSP, (SEQIDNO:4412); XM_005619461.2, LOC102153808, Ins, C_7, HPPTAEEAALGSIAYALG, (SEQIDNO:4413); XM_541491.5, SCAF1, Ins, C_7, HPQEVQAGAQAEWWRGQGGCLIVFGCTAR-PASPGLPLGLQEAPLPGPQARLACLVV RPPPFAVPL-SPPPLAQH, (SEQIDNO:4414); XM_005633166.2, LOC102155774, Ins, C_7, HPRQPAGFWGRRHS-GLEPHNRCFCTEVERGTSELME-GRPQGEATWTPVHRPHPPP GQV, (SEQIDNO:4416); XM_005633167.2, LOC102155774, Ins, C_7, HPRQPAGFWGRRHSGLEPHNRL, (SEQIDNO:4417); XM_003639255.2, LOC100856208, Ins, C_7, HPSNRGGL, (SEQIDNO:4418); XM_014110188.1, AHDC1, Ins, C_7, HPTALASHPAPCQPT, (SEQIDNO: 4419); NM_001003008.1, RHPN2, Ins, C_7, HPTDGDLVYLV, (SEQIDNO:4420); XM_014119265.1, C15H12orf74, Ins, C_7, HPTPVLREHSSEPPVLILCTTE-QDTSLGSHITPQARASYDGRWHRKSLPRGYILIRTHW LPSKRVQ, (SEQIDNO:4421); XM_005630123.2, C17H2orf50, Ins, C_7, HPWAPENLVRWVPAALNQAAS-RRFPHCPRWPRGGQGSPSPPGPRSGALGPGNERCA AGPAVEGALGGREEGPAALGSALEFPERLRSPGQ, (SEQIDNO:4422); XM_014119807.1, ATG9B, Ins, C_7, HPWGAQRFFLTSARGLIGQPLGAAPPAPTGPEPHSPLPSCCHSQPPGLHFPPCPGPQL CVSRGHWGPEAGPASRACFC, (SEQIDNO:4423); XM_005635260.2, OSBPL2, Ins, C_7, HQCILFRRPQSGLPVSRLHLPEAEVLGQERGGRAPGDHHAGAAQTQ, (SEQIDNO: 4424); XM_540140.5, GALNT14, Ins, C_7, HQHHHHLPQRGPLHPAQNHPQRIKSHTYESDPGNHISG, (SEQIDNO:4425); XM_014106406.1, LOC102156658, Ins, C_7, HQLRASDMRRAVAAGRSLAPLPPSHASDLLSRACVQRPGSAADVEEPAAGCGDPGP RGGLSADAR, (SEQIDNO:4426); XM_003639777.3, SYDE1, Ins, C_7, HQNLPHEVPRPSQASVHEDEEAARP, (SEQIDNO:4427); XM_853531.4, ARPP21, Ins, C_7, HQPAAPARGNDGAVPAAATATAFSSATAAGATTPATHGRPTGHSERRCGDTVHPDE PEPAILRRDS, (SEQIDNO:4428); XM_014114167.1, GTF2IRD1, Ins, C_7, HRHLLLCGQLPVQHRAP, (SEQIDNO:4431); XM_014107801.1, CCDC92, Ins, C_7, HRLRPQLK, (SEQIDNO:4432); XM_005639690.2, NKD2, Ins, C_7, HRPGPGAPSLQDGG, (SEQIDNO: 4433); XM_014107017.1, CHD6, Ins, C_7, HRPQRLAWGICNRSLLHVRGVSRSHVSFPSERQHP, (SEQIDNO:4434); XM_005624410.2, HDAC5, Ins, C_7, HRRRGVPNGLQDSGDAHCPRVLT, (SEQIDNO:4435); XM_014121827.1, PTPRS, Ins, C_7, HRTVSPPSRR, (SEQIDNO:4436); XM_014106943.1, RIN2, Ins, C_7, HRVADPRRPN, (SEQIDNO:4437); XM_547143.4, ZNF500, Ins, C_7, HSAAPGGPWAKVQPPLVELSASEVPFGISRSEFM, (SEQIDNO:4438); XM_847340.4, UBAP1, Ins, C_7, HSCSKQYQISVLPQT, (SEQIDNO: 4439); XM_014122294.1, LOC100685073, Ins, C_7, HSCSNQYQIPVLPQT, (SEQIDNO:4440); XM_014116490.1, GAS2L2, Ins, C_7, HSRKQLSRYCKWRSYDRIGEWPHSKGCHWGPGWV, (SEQIDNO: 4442); XM_005628998.2, CC2D1B, Ins, C_7, HSWPGARCGHRGRCGGSYFSCCPEAGFLGGSSPSRGGGGGGG, (SEQIDNO:4443); XM_014121888.1, MAP4, Ins, C_7, HTCAQEAHCCQD, (SEQIDNO:4444); XM_014110312.1, AHRR, Ins, C_7, HTLCLPGARAWPS, (SEQIDNO:4445); XM_005627115.2, DDR1, Ins, C_7, HTRLGQTHQHPGLQWGLYGA, (SEQIDNO:4447); XM_014113005.1, FAF2, Ins, C_7, HTSGGRTQPHRSSLCSGPDR, (SEQIDNO:4448); XM_849841.4, APOA1BP, Ins, C_7, HVHVPEPPRGPGHLRTWK, (SEQIDNO:4449); XM_852361.4, TCF20, Ins, C_7, LAEQDSERQPQHRAVGAGV, (SEQIDNO:4450); XM_535696.4, ENPEP, Ins, C_7, LAGPFARDPAARGPGGLSRQRR, (SEQIDNO:4451); XM_014117046.1, GARNL3, Ins, C_7, LAIPTGVYRPPGIQGLFASEVN, (SEQIDNO:4452); XM_005617744.2, ARID1A, Ins, C_7, LARHEEQFGWDPGCLS, (SEQIDNO:4453); XM_005617746.2, ARID1A, Ins, C_7, LARHEQEQFGWDPGCLS, (SEQIDNO:4454); NM_001205203.1, MEF2B, Ins, C_7, LARIPHWERLAPLL, (SEQIDNO:4455); XM_014109253.1, PCMTD1, Ins, C_7, LCCQESTGLGSYLYSTYT, (SEQIDNO:4456); XM_536887.5, RNF216, Ins, C_7, LCLRAPALPPATCPAHVQQLPSQHGPRPSPLRAPSAQCARQLRLCSRPYASGAQPAY ALWPPATASLL, (SEQIDNO: 4457); XM_005628976.2, GJB4, Ins, C_7, LCPLPGRAPPGRELCPHEGRVSLDGRRWVPI, (SEQIDNO:4458); XM_014119660.1, MKNK1, Ins, C_7, LCRSLWDRLWLGPGRSLQGVPEQAI, (SEQIDNO: 4459); XM_014121833.1, LMNB2, Ins, C_7, LDARVEDPEQLGHWRELPDCPGQR, (SEQIDNO:4460); XM_005627762.1, C12H6orf132, Ins, C_7, LDLHPGGPGGGEPRAGWDLCWRQSV, (SEQIDNO: 4461); XM_542953.5, PLAGL2, Ins, C_7, LDSRCKAGGGSGLETSSQASGPGGGESSEVPM, (SEQIDNO: 4462); XM_014118922.1, TEAD2, Ins, C_7, LECSRCEAILTDTVLVTDPPN, (SEQIDNO:4463); XM_014122225.1, TYK2, Ins, C_7, LEIHRAHRPHPGADDGAEAHRAAGTRGEAAPAREMSL, (SEQIDNO: 4464); XM_005631964.2, ZEB2, Ins, C_7, LERLFITQVARKAYGLHNFTIHSRTPQQCNEL, (SEQIDNO:4465); XM_014113085.1, SAL13, Ins, C_7, LGFSGRRNGQSTHWQ, (SEQIDNO:4466); NM_001014375.1, NFKBIL1, Ins, C_7, LGGAGGSEEVLKGPAGPLAP, (SEQIDNO:4467); XM_845370.4, ZNF750, Ins, C_7, LGLRPLQVLPAVPSQPAHSIRVLQTRVCVLLLRSQTPGRRRCFQRSKLTPPGRSCPAL PGPESVQVKSFQHPQKAHRV, (SEQIDNO:4468); XM_542926.4, CPXM1, Ins, C_7, LGPGVPASFG, (SEQIDNO:4469); XM_005642488.1, C1QTNF8, Ins, C_7, LGPQRLRPQEQWGAVGAPALHAAPH, (SEQIDNO: 4470); XM_539044.5, BACH2, Ins, C_7, LGSRWRPPLLLLLLLLLGELHEEAGGQRPGGLPGEGASAGIQEPDGDRGL1PGND, (SEQIDNO:4471); XM_014111337.1, FOXP3, Ins, C_7, LHLRHPDPLGHPGGS, (SEQIDNO:4472); NM_001168461.1, FOXP3, Ins, C_7, LHLRHPHPLGHPGGS, (SEQIDNO:4473); XM_005634969.2, FAM83C, Ins, C_7, LILTLQHQPQQHQTLTSNGPLFLSRSTRW, (SEQIDNO: 4476); XM_014122716.1, PLEKHA7, Ins, C_7, LKQRTPLHLCL, (SEQIDNO:4477); XM_531753.4, BPIFC, Ins, C_7, LLASSFCTARTQ, (SEQIDNO:4478); XM_005619043.2, ZSWIM8, Ins, C_7, LLCCMPGHNLVLFLSVSPSGFCSLPACPSLRVPVSAAEGPAAEVCPVPHQ, (SEQIDNO: 4479); XM_014113364.1, ARHGEF12, Ins, C_7, LLCRLTKPDHGVHS, (SEQIDNO:4480); XM_014116208.1, ITGB4, Ins, C_7, LLLQKCYQPDRKLGGVSE, (SEQIDNO:4481); XM_545640.4, RUFY4, Ins, C_7, LLPEGRGSVPL, (SEQIDNO:4482); XM_014120042.1, MEGF8, Ins, C_7, LLPNASIPRGMSTSPDLQ, (SEQIDNO:4483); XM_854764.4, MAP1A, Ins, C_7, LLSFYIVGRWEALSWCDHKPW, (SEQIDNO:4484); XM_005634296.2, ZBTB47, Ins, C_7, LLSSCLFPARVPGRPP, (SEQIDNO:4485); XM_014109500.1, CILP, Ins, C_7, LPAPCHKHCQRKSVLKETATG, (SEQIDNO:4486); XM_005636541.2, ZDHHC8, Ins, C_7, LPAQHAPLTLLCRPQSCRLHPHGPPPRVATLAGRAKGPPSAEDPPK, (SEQIDNO:4488); XM_848542.4, LURAPIL, Ins, C_7, LPAVLLLVLSNLRLPTSQPLQRPGEAGNQAALPQAGDG, (SEQIDNO:4489); XM_014117280.1, LOC102154639, Ins, C_7, LPGQPVPDESRRQK, (SEQIDNO:4490); XM_005621049.2, PILRA, Ins, C_7, LPKKSPQEETLYSIL, (SEQIDNO:4491); XM_014119801.1, LUZP6, Ins, C_7, LPLAASDWYL, (SEQIDNO:4492); XM_014114806.1, HIAT1, Ins, C_7, LPLWSLFRTAGSACCLVYSRTYQFKLTVQQLEKALWQSQPSS, (SEQIDNO:4493); XM_846788.3, SLC9A5, Ins, C_7, LPNLCREGA TLEEWAGRSGSLRVLGNHQDCARGHAGRLEPEHLVPGEPGIPALYPGPNYDPPASLP TGC, (SEQIDNO:4494); XM_014115086.1, NSL1, Ins, C_7, LPPFRSHSSRPRFKLERWRGLPCRGSLPVRGAWRERRGRTIGRRSPPAPGRTAGCAA RRSGP, (SEQIDNO:4495); XM_014116573.1, DACT3, Ins, C_7, LPQPGPGPWHVRRA, (SEQIDNO:4497); XM_014106807.1, DCLK3, Ins, C_7, LPQPREGPG, (SEQIDNO:4498); XM_014109759.1, NRIP1, Ins, C_7, LPRARGLRGLQAGAGASERLCGRRRQGPH, (SEQIDNO:4499); XM_544370.5, ZNF366, Ins, C_7, LPRLLVLQAQR, (SEQIDNO:4501); XM_845833.4, LDB1, Ins, C_7, LPSRHHARSGCGPNSHVPAYIPGAWDWEAHTIWQPN, (SEQIDNO:4502); XM_014121756.1, LOC106560089, Ins, C_7, LQPRTPGWWFLVTAAAAGKEHSLGALPQVCVQGSQRGKVSPHPEWREHHSQKSLVLAAVVLFKPLLIS1, (SEQIDNO:4503); XM_534025.5, ART1, Ins, C_7, LRDLPGDQCQ, (SEQIDNO:4504); XM_005637736.2, TCF7L2, Ins, C_7, LRLHCQHSSLQGHEKEPLLTQGWGALVFGVEQSARRAAPSPCSPSHAAHHVQQ, (SEQIDNO:4506); XM_005616728.2, GRAMD1A, Ins, C_7, LRLPATAR, (SEQIDNO:4507); XM_846468.4, C7H1orf116, Ins, C_7, LRQRQDLPQRRP, (SEQIDNO:4509); XM_014121534.1, VHL, Ins, C_7, LRRRGPPSSRGAASACWSPPSL, (SEQIDNO:4510); XM_548978.5, CFP, Ins, C_7, LRWRCRPNPHLQYSCALPCEWRVGVLGGVEHLCPSGHKHHV, (SEQIDNO:4511); XM_545122.3, GPR156, Ins, C_7, LSGLCTFLRGASCKSDCVWGAQRAANRAEQGQCQPGPAKC, (SEQIDNO:4512); XM_014113971.1, RLTPR, Ins, C_7, LSLSQPQPTKSQPLPRQPGPPRGPLLGPQE, (SEQIDNO:4513); XM_014116505.1, FMNL1, Ins, C_7, LSPADPCPQQEDPEEFSHC, (SEQIDNO:4514); NM_001003009.2, TPO, Ins, C_7, LSRVGPVQEHQGWFQV, (SEQIDNO:4516); XM_005621867.2, CDC14A, Ins, C_7, LSSVQGCFLWKLHL, (SEQIDNO:4517); XM_014117336.1, MKL1, Ins, C_7, LTHGHLGIALCP, (SEQIDNO:4518); XM_014106880.1, RBBP8NL, Ins, C_7, LTPTAPLPGPSEGRHGEDAGRPRGGRGRPCRKVCGLQDISSGQNLPECQPA, (SEQIDNO:4519); XM_843722.4, MAP3K12, Ins, C_7, LTRTESSWQDSAPEGQRQGQLRRPAWASRGFATP, (SEQIDNO:4520); XM_014120830.1, UPP1, Ins, C_7, LVLALSSSLSQVNKI, (SEQIDNO:4521); XM_005631651.2, LOC612278, Ins, C_7, LVLLTSPSC1HFLPSWAPSLAASLLPVVYFLFCYPAEEVGGLGLDDDLLCSHLPHLRA VFGTERRPGPFLHGQVPGKHLVCMGNTDEPYPHAH, (SEQIDNO:4522); XM_538253.4, 42438, Ins, C_7, LWGHQPPPGCPAHADALASALWLHNPAPPWTAAATRCPFQFPFWPRGCHEGHHGV, (SEQIDNO:4523); XM_548302.6, CORO6, Ins, C_7, LWPPPQPVGQRRLPVAAAHPGDAAGGDQGPARAGAGPGAAHHGPGEHAVRAGGR HRL, (SEQIDNO:4524); XM_005624896.2, CORO6, Ins, C_7, LWPPPQPVGQRRLPVAAAHPGDAAGGDQGPARAGAGPGAAHHGPGEHAVRAGGRH RL, (SEQIDNO:4525); XM_014119957.1, MGAM, Ins, C_7, LYATFGVQG, (SEQIDNO:4526); XM_005631240.2, SPI1, Ins, C_7, PAAAALPPHGAGADARARHPHGSEPRGHRPPGLLSTPDVPPIPLSVPGPA, (SEQIDNO:4527); XM_014114719.1, UNK1, Ins, C_7, PAAAHPQVRARSAGLVGRVLLPGAERRPREHLGLCLRQLLSQPDPDPEPRPCPFVRR EPQRCGAGPGQAAAGRGQEEDPAMGGVLAAGEAGV, (SEQIDNO:4528); XM_014114715.1, UNK1, Ins, C_7, PAAAHPQVRARSAGLVGRVLLPGREPQRCGAGPGQAAAGRGQEEDPAMGGVLAA GEAGV, (SEQIDNO:4529); XM_014108311.1, LOC106557876, Ins, C_7, PAAAPPAGARAHRRPPAPGRPPAARGIPPARRPPALSPAASRSGARAPTNPREQPV, (SEQIDNO:4530); XM_847178.3, PTPRU, Ins, C_7, PAAAPRGAHLPHHPAQHQLHHWRRADRAQGD, (SEQIDNO:4531); XM_545733.5, SPTA1, Ins, C_7, PAAARRTKHHRPAPGRHREPVPLPP, (SEQIDNO:4532); XM_014122224.1, RFX1, Ins, C_7, PAACHRCYPPAPICH, (SEQIDNO:4533); XM_014108558.1, LOC106557908, Del, C_7, PAAFKAPTMQRWRPSSVTMSLRAPANPRGAGGEAAEPRL, (SEQIDNO:4534); XM_014110188.1, AHDC1, Del, C_7, PAAGHPASPSRYTRHPTRRASPTSCTGCRASDGAVGKQAVLVAGAGATQPRQPDAP SVTSLRALARKRKWWRWRLLVLGVPASPNWGTRANGAGGRWTP, (SEQIDNO:4536); XM_850276.3, NCCRP1, Del, C_7, PAAGSRCPTSSASMAPGCASSTSCTRPRTGGSPVGCGGQG, (SEQIDNO:4537); XM_014119392.1, LOC475337, Ins, C_7, PAAGVPGTSPAWHWHCGETNQAPGQLL, (SEQIDNO:4538); XM_850293.5, UCKL1, Ins, C_7, PAAHQQAHHLHGRPAALVQRARHAVQGGLCHWPGRWQRLGEDHRGPDDHRGPG RALGGPAVHGLLLQGAHHAAAGAGRPQQLQL, (SEQIDNO:4539); XM_014117260.1, PPP6R2, Ins, C_7, PAAHVSPQVRARAPRACGNPPRPSCGRAPRGHPRCPGQRPRDDRSGAPGGRHHCGP SHVHSSCSGDRDEG, (SEQIDNO:4540); XM_014115697.1, LOC102152805, Ins, C_7, PAALAAPAHLSGGH, (SEQIDNO:4541); XM_014115611.1, CTIF, Del, C_7, PAALMPPPQGLLKGCPRSSQGVRRLRQSVKTVLFPSASGSGPKLPCSSLPKTGCGEG, (SEQIDNO:4542); XM_005621599.2, UBA1D1, Ins, C_7, PAALPPHRHRQLPRPELACCSLTPGGPTAPPATAAAPVDSGTPLPGVRLATLGPPTGR FRTEGPPCDGG, (SEQIDNO:4543); XM_014108123.1, LZTR1, Ins, C_7, PAALWAHHGGL, (SEQIDNO:4544); XM_003639660.3, B4GALNT4, Ins, C_7, PAAPASRPQDRPPPGRAAADPCPGSGHAGQPGGPGARARPRRGHRGLELVVGSTAR DFLPELVPGVRAAAAWGGRAGGGGGGGRGQGPGRGGQ, (SEQIDNO:4546); XM_014121373.1, LOC106560025, Ins, C_7, PAAPGLPP, (SEQIDNO:4547); XM_005638641.2, CSPG4, Ins, C_7, PAAPGRRALLPCTARPRTAGPRAAPARGPAERGGPSSGDPQRFLLERGRTAADPLCA RRE, (SEQIDNO:4548); XM_014119462.1, SLFNL1, Del, C_7, PAAPRGGPCGGPGARRGARALTAPSRTRRSWARSASSRAPSWAARRAVWSSSAAA VST, (SEQIDNO:4549); XM_014108277.1, LOC106557868, Ins, C_7, PAAPRPQPPLPFTCSRERLRLRAEARPWAGQEGAGVPPGRPRRLAGPAGAPAAREPS RSPRLSLASSRLPRPPAPASLKHSHAGSSAL, (SEQIDNO:4550); XM_014120347.1, ASAP2, Ins, C_7, PAAPTECCQRSLGSHTAPSSSKNAQCDRSLEPAEQACPAWDLTEQSPTPAPAAPAAQ PPPPEEACSRG, (SEQIDNO:4551); XM_005638677.1, CHST14, Del, C_7, PAARPRPGAGPSPGPGRCPWSPGTRTGR, (SEQIDNO:4552); XM_014106264.1, LOC106557546, Del, C_7, PAARTGVWSWPELLGPQAASRLTVQQGQAWAKRVV, (SEQIDNO:4553); XM_003433444.3, HIC2, Del, C_7, PAASGYPQPPSFRRGIQGLWTDAKGPIPPRSSPRPKAQMTSFSSGAPARRVCMAWAG PSVQPVGRPAWAAAAPMGAVGAVSRS, (SEQIDNO:4555); XM_005631072.2, RIC8A, Del, C_7, PAASPGCRASASCPGTEAAWTLSPAARACRPLPAMPASPWRGLARSLWTWTLSSSP, (SEQIDNO:4556); XM_014116213.1, SDK2, Del, C-7, PAASPLAPG11, (SEQIDNO:4557); XM_014121607.1, KBTBD8, Ins, C_7, PAASQNRLQTGVLLW, (SEQIDNO:4558); XM_005635063.2, LPIN3, Del, C_7, PAASSQKGSPHRKPKTSTPTLMASGVPRPASCQVG, (SEQIDNO:4559); XM_014114365.1, SETD1A, Ins, C_7, PAASTPSSSTPSSSSIPGFPAPCLSSPPAGIPLPTAP, (SE- QIDNO:4560); XM_005629808.2, KAT6A, Ins, C_7, PAATAATAARPTATTAPAPAA-TASAPTAAAAPAVTVQYEQQFHSSAHDHGDP, (SEQIDNO:4561); XM_014121835.1, JSRP1, Ins, C_7, PAATATPGPQRRAALGRPVAQQVPGARLLG-GAAGLCLPAVPGCCGRGRSRARTCP, (SEQIDNO:4562); XM_847216.3, RD3, Ins, C_7, PAAVPPEAG, (SEQIDNO:4564); XM_858879.4, EPHX1, Ins, C_7, PAAVQQHPKALADGTRLAWLLLRV1, (SEQIDNO:4565); XM_014118793.1, JRK, Del, C_7, PACCRAATPA-TAPTMPSSTWPAPGVLCQATSSAAPGRSCGPR-SHLPKARLLTRSQMA SR, (SEQIDNO:4567); XM_546894.5, CDH5, Del, C_7, PACCSPTGAR-RETGFGTRCTSMKRKTPRYPIMWARSNRV, (SEQIDNO:4568); XM_844246.4, RBM17, Ins, C-7, PACG-GRPEGSCSQWIFCRRSFDSFS, (SEQIDNO:4569); XM_005642274.1, LOC102152225, Ins, C_7, PACPRPPTARSRARRACRAPN-SALRGPKPASPLLGVLPPPWPPWLGGGVPGRSALGP PRKGRREARGGCWGGASLRVCGRAFSGEPVA, (SEQIDNO:4570); XM_014110256.1, TNK2, Del, C_7, PACPSPRGPPAHGASCLQPPQARRR, (SEQIDNO:4571); XM_005639078.2, SCARB2, Ins, C_7, PACVCPVLFLQCHQSRGDPPRGDPSVRRS-GAIYLQGT, (SEQIDNO:4572); XM_014115407.1, KIR-REL2, Del, C_7, PADCIELGQVISPHPTLEL-SPATSNLHPLDPQIWTPGLYPSPMLPSPHPATRVSRLMY, (SEQIDNO:4573); XM_005633153.2, SBNO2, Ins, C_7, PADPAVRVQCPEHHAALLLVESLLA-HAVPSLLQRKPPVHELHLLHRQPALRRHQLW TLHHHP, (SEQIDNO:4574); XM_014118366.1, PHF1, Ins, C_7, PAE-PLWCPPTLGPSLPCSHLRPQASTLGGSRCAGQVDGW-TAILGDHQESGQFPGGVS GPV, (SEQIDNO:4575); XM_014114725.1, CHTF18, Ins, C_7, PAEPRGPP, (SEQIDNO:4576); XM_014108968.1, PDZD7, Del, C_7, PAESEPPRP-WAASSSSTPPSKPTVMKVTSSMQSGWRRVQQAD, (SEQIDNO:4577); XM_014108967.1, PDZD7, Del, C_7, PAESEPPRPWAASSSSTPPSKSGLACAWGTRSQK, (SEQIDNO:4578); XM_845909.4, AVPI1, Ins, C_7, PAETTG-PLTAPLQPAQNPRALRSTGQPTEW, (SEQIDNO:4579); XM_014109027.1, AVPI1, Ins, C_7, PAETTGPLTA-PLQPAQVGSWNWKAEGRIPEPCAPLANPQSGSTE-TASGDQYL, (SEQIDNO:4580); XM_014112966.1, TULP4, Del, C_7, PAFALTSPPPSSLPSSPQFQIPTT, (SEQIDNO:4581); XM_548250.5, ACACA, Ins, C_7, PAFRHADIYGARVG, (SEQIDNO:4582); XM_005631741.1, KCNQ1, Del, C_7, PAGAGSRWFSPAAPSTPSSSCPATPCPPTNS, (SEQIDNO:4583); XM_005635367.1, LAMA5, Ins, C_7, PAGARAVGLSHAHRGRSLAPALHQAWRSTSHHQ-DAHRPGLQ, (SEQIDNO:4584); XM_005640917.2, SUSD4, Del, C_7, PAGCWPPSCGSSWR-CASGPHSSRAIAASLRSKMRRSVTRPTDVGTR, (SEQIDNO:4585); XM_537262.4, DENND4B, Ins, C_7, PAG-GLLRDSRACRERSSHSRGDTGSRTQWAPAPSPASRA-HHRHGGHCSGTGRGSAP GLHLHPVLRWGPPLGTQC-RALGWNAARHLLPQGP, (SEQIDNO:4586); XM_005616244.2, VSIG10L, Del, C_7, PAGNFQIS-FQVQMPRLLSLIPNGFPRPQILTMCLGPSGQMFLL-RAKS, (SEQIDNO:4587); XM_005638841.1, IFNGR2, Ins, C_7, PAGPGVPAPGQQPSRAGGAPAAPA, (SEQIDNO:4588); NM_001003009.2, TPO, Ins, C_7, PAGPWSGPGRRLWQPGAPPRAAGQDPGRGPHIQ, (SEQIDNO:4591); XM_014111450.1, TNFRSF8, Ins, C_7, PAGQASPDFLSKLQGQDHASWRGCSPHPGR, (SEQIDNO:4592); XM_014109338.1, DUOX1, Ins, C_7, PAGQPHPIWQPRTPGPAAQDPQGV, (SEQIDNO:4593); XM_014109349.1, DUOX2, Ins, C_7, PAGQPH-TVQQPWMPYPATQDPQGV, (SEQIDNO:4594); XM_005630789.1, SEMA6C, Ins, C_7, PAGRAQRQPSPP1, (SEQIDNO:4595); XM_545878.5, TMC3, Ins, C_7, PAGSLSTAE, (SEQIDNO:4596); XM_547741.6, LRRC16B, Del, C_7, PAGSQDSGAASPQPVAPGRICLSCPLTAIN, (SEQIDNO:4597); XM_014109371.1, LOC106558039, Del, C_7, PAGSSPAGVPSRSPRPDPVTALRATRTSALGEKR-CRLFGEARGSCGEGGRRRLSKPVS SGWAAQDQN-WHGCAGKRGTPTAGGLVGGYPPGVVLKGLALPL, (SEQIDNO:4598); XM_005626204.2, SBF1, Del, C_7, PAGSTGASPLPRTRRMRSQCRRSWSPAR, (SEQIDNO:4599); XM_005624000.2, GCGR, Del, C_7, PAGTP-TRAGPQAAPPARSCCFPGAATGRPGTPLQTPAW-WASPLGWPPAPSRARRSPP GPRLGPDSGA, (SEQIDNO:4600); XM_014117947.1, KIF12, Ins, C_7, PAHGDPEHTTSAER, (SEQIDNO:4602); XM_014117945.1, KIF12, Ins, C_7, PAHGDPEHTTSAER-WGCSSKPGPETGGPQRPDWQL-PATRPGPGTPQRGCTEPQPRPP ALL, (SEQIDNO:4603); XM_843488.4, NAV1, Ins, C_7, PAHHQRGLEAAGIL-PRL, (SEQIDNO:4604); XM_014106882.1, COL20A1, Ins, C_7, PAHLGGAQAPWTRRTGQSPPRGQRRAQN-PRSHGQPSAERERASKTPDRNG, (SEQIDNO:4605); XM_014121353.1, RASSF7, Del, C_7, PAHRTFCLRPEK-SPSREPAQNPTLVSSLSPEIAPMRENSWR, (SEQIDNO:4607); XM_014106880.1, RBBP8NL, Del, C_7, PAHSTS-TASPWTASCGPPGPPSRPMSP, (SEQIDNO:4608); XM_014116619.1, SP2, Ins, C_7, PAHTTETRPHQTCPSP-SQSWQE, (SEQIDNO:4609); XM_014116066.1, PGF, Ins, C_7, PAIGLVCWKWLIRGGSGALPASVGTQLLPGTGE-AGGRLVGVPG, (SEQIDNO:4610); XM_005617069.1, PARD3, Del, C_7, PAKASRVPRRTPGTPATKDPGTAT-WAGTASMPG, (SEQIDNO:4611); XM_543139.5, PDSSB, Del, C_7, PAKPNTPFIVSMRYFLVKRPSLHR-YLSLCIRA, (SEQIDNO:4612); XM_854849.4, SGK1, Ins, C_7, PAKSFSANQLGTIIQSSC, (SEQIDNO:4613); XM_005640017.2, RREB1, Ins, C_7, PALAKAPRDGRAAPAGLHRPDHLVRVLGAHLAEG, (SEQIDNO:4615); XM_014108268.1, GRIN2B, Del, C_7, PALALLSSSWALQTRWPSRMPTRKMISTIS-LWFPVWSW, (SEQIDNO:4616); XM_548978.5, CFP, Del, C_7, PALAMPSEPTSAIQLCPA1, (SEQIDNO:4617); XM_005625544.2, MBD6, Ins, C_7, PALCPECPPTWT-TYLQCHHGNY, (SEQIDNO:4618); XM_014109870.1, COL6A2, Ins, C_7, PALGADLAQHLLLLVSVLQ-GELSGDPRAPRPQGLPRTEGRQGQHGRARRTRA-EGSP GRSRHRRPHWLPRTQGCSWLQRREG, (SEQIDNO:4619); XM_014121266.1, LOC106560005, Del, C_7, PALGLLGHPAALLPAPPGPRPGGP-PAATAQCPAAEGVSSGQLTEERLTPPRGSERGRR RRDASGLPQAAEPGRGRSATCWPRRVARPRRPRP-PRELAPHR, (SEQIDNO:4620); XM_014122638.1, ARAP1, Del, C_7, PALGRHACW, (SEQIDNO:4621); XM_846117.4, ST5, Ins, C_7, PALHPSPTSH-SETQEGPAWSPQVPEQKIL, (SEQIDNO:4622); XM_014113910.1, RERE, Ins, C_7, PALICSAP-LCPWGDTHHPSNLLFHLHATCGTRPL-SPAAVLCCCFFGRQHTWGDSLPA PHCPDQGRGSG, (SEQIDNO:4623); XM_014121848.1, ODF3L2, Del, C_7, PALLLLCSSSAGPFTSVPTRTPALGPSTSWTQKSPG-LAEAAPLPTPCRAGASLGVWR, (SEQIDNO:4624); XM_005621146.2, SDK1, Ins, C_7, PALLRQPLHE, (SE- QIDNO:4625); XM_005617128.2, BEND7, Del, C_7, PALLTHAHTPLTKTEAKAKKKKKEKEKGGGSFKHQKAAR (SEQIDNO:4627); XM_014116870.1, COL5A1, Del, C_7, PALPACRVLLGQKVLRAPRVPLAQRVRLATQDPLAHRVPLARSSSPCRSRHPGPGGT LTPASCWMTGPARAMWTTRTAWRKSSARSTP, (SEQIDNO:4628); XM_005640656.2, ZNF142, Ins, C_7, PALPLLRLCVPPPAGARSPREGARGHPALQVYRLRLQHQKPAEDHLAQPHPHGRKA LPLSPLSLCLR, (SEQIDNO:4630); XM_005619085.2, ZMIZ1, Ins, C_7, PALPPSGHAQQHGRPRETPQSPHAGNSPSRTHKSR, (SEQIDNO:4631); XM_005619086.2, ZMIZ1, Ins, C_7, PALPPSGHAQQHGRPRETPQSPHAGNYATRWQF, (SEQIDNO:4632); XM_545531.5, WIPF1, Ins, C_7, PALPWKPRCSFCRRLPPPDILKLLIILLQQASPAPHAQQGLG, (SEQIDNO:4633); XM_014109365.1, CDAN1, Del, C_7, PALQGRSLHVGSTQLR, (SEQIDNO:4634); XM_005621001.2, COL26A1, Del, C_7, PALQVPLGHMVPQDPQVYPDLRAWLESGA, (SEQIDNO:4635); XM_539219.5, FOXH1, Ins, C_7, PALRAASVAALPAHRAQESRWGGFPGGDQQAPTPFP, (SEQIDNO:4636); XM_533664.5, LTBP4, Ins, C_7, PALRLWPV, (SEQIDNO:4637); XM_848478.3, PRDM15, Del, C_7, PALSCACGTRPSMPRRWTSPC, (SEQIDNO:4639); XM_005641877.2, GPR101, Ins, C_7, PALWLGPGCLRPAQCPLLHDLGGQPQLHHPQRRVLHHHSTGCHDCLLLRGVWCRT AAACSAVQRQEPQPGGSSQGPCGE, (SEQIDNO:4640); XM_005628127.1, LOC102154750, Del, C_7, PAMELPPHPPSATRRCRQVAPRHGGL, (SEQIDNO:4641); XM_005634655.1, MED12L, Ins, C_7, PAPADPAAPESDPWSPSDAAAAAFEENIPEIF, (SEQIDNO:4642); XM_014109867.1, LOC611835, Ins, C_7, PAPAPLRGFRVSPVSGRAPGPWGPWSAVVFLNPGPTHVLLFGSLSPRLHPTPAGPHA LRVPPL, (SEQIDNO:4644); XM_005635288.2, CHRNA4, Ins, C_7, PAPAPVSGPDAGGGGRPVHRGPPEGGGHRLLGEGGLEVRGHGHRPNLPLGVHHRLP AGDRGPLPAPLAGRHDL, (SEQIDNO:4645); XM_005631006.1, COBL, Del, C_7, PAPAQETIRPLAGPWRMGPGGSPSTPSPLAPRAGWTPMMAPGRSPWNRRKNRVCRA QDTNPMAPCPPASSGQRRNSAQWSRSQLRKTRRCTAP, (SEQIDNO:4646); XM_005633014.2, ZNRF4, Ins, C_7, PAPARSPAARP ATGPWEALEMPEGLPSAVPSGT, (SEQIDNO:4647); XM_005628317.2, GPT, Del, C_7, PAPCSALRN, (SEQIDNO:4649); XM_005618215.1, LOC102151979, Ins, C_7, PAPGGPRGPGLAPLPAACDPRAQALEPRAPRGRFSHGGLGGWQESGR, (SEQIDNO:4652); XM_003434863.3, VASN, Ins, C_7, PAPGLPGVHLPQRGHLSPGGAGPPGVPVP, (SEQIDNO:4653); XM_546603.2, ALOX15B, Ins, C_7, PAPGPSGQGVQRGRCGGLPGGVPPGRGPAAAAARAQGAPAAARPGRAGGP, (SEQIDNO:4655); XM_014116627.1, TMEM145, Del, C_7, PAPGPSTCGATSAPKRTGCS, (SEQIDNO:4656); XM_014121541.1, IQSEC1, Ins, C_7, PAPGQPPGHQRLSQ, (SEQIDNO:4657); XM_014120658.1, LOC100686114, Del, C_7, PAPHAKGRNWIRWQ, (SEQIDNO:4658); XM_005640394.1, LOC102151535, Del, C_7, PAPHAPPFPARSA, (SEQIDNO:4659); XM_856636.4, BRPF1, Ins, C_7, PAPHHGLPTSAQAG, (SEQIDNO:4660); XM_014121835.1, JSRP1, Ins, C_7, PAPIPSSDPQLRSGPRRLHDHQGAAGAGWRPGQQPGRRGPVHTGGPLPCPAPGRQGS R, (SEQIDNO:4661); XM_014112867.1, COL13A1, Del, C_7, PAPKAPQESLDRQE, (SEQIDNO:4662); XM_014114212.1, LRCH4, Ins, C_7, PAPLAPFWSGGLHFF1, (SEQIDNO:4663); XM_005621001.2, COL26A1, Del, C_7, PAPLAQQAARPSLQTAPRASSTPCSLRRTRATETHSWLLLLWTQCWPASQGPGAPPA LQVPLGHMVPQDPQVYPDLRAWLESGA, (SEQIDNO:4664); XM_014119269.1, LOC106559733, Ins, C_7, PAPLASPWRWL, (SEQIDNO:4665); XM_014118255.1, COL9A1, Del, C_7, PAPLEFQASMASTVTEVPRVPRAPRVLLENRASQELRASRARRAPTD, (SEQIDNO:4666); XM_005630809.2, POGZ, Ins, C_7, PAP1GKKIHPKSLEPEGGFLSPAGRRALHGSLSAVSPSPRPLPCSHPLLPAPGARSL, (SEQIDNO:4667); XM_005631406.2, SSH3, Ins, C_7, PAPLPVGSLHKGTPEPG, (SEQIDNO:4668); XM_014114924.1, LOC607201, Del, C_7, PAPLPWCT, (SEQIDNO:4669); XM_014113968.1, LOC610373, Del, C_7, PAPLRHHPLTSCSVPGPQAVGSLPSTPS, (SEQIDNO:4671); XM_548172.4, HOXB1, Del, C_7, PAPLRLLTVQARPAMVGDCPAPRSSRTQAIPPSSRPRRSGCPSPAPRPRGMPRPPAA PAMGPLSTILWASRKEMEAIIILRAMGPS, (SEQIDNO:4672); XM_014113137.1, RPS6KA2, Del, C_7, PAPMHIICLEDSVLWPQVWSRSPRNKICTKPRSIPSCSSYMETTSTSLMAMRSKRTSG WAPTPCASAVCTKLLRQSMP, (SEQIDNO:4673); XM_014107689.1, LOC100855783, Del, C_7, PAPPAPPAPPPRLLTRRLLSCRTPGPTRTRKRRRPISFPTETPC, (SEQIDNO:4674); XM_536512.5, PDZD2, Del, C_7, PAPPAPPARLPPQPHPPRGASRRAAARSPRPCPAPSCRS, (SEQIDNO:4675); XM_014114446.1, MSLN1, Del, C_7, PAPPAPPPGPPAPHLGCPTQPPPRASPGMTPLPPAAHQPTGCTCHSPWPCPWASCGCC TWAPQAPARIPCGAPAPRPPKMALPQHRMQGNRG, (SEQIDNO:4676); XM_014107689.1, LOC100855783, Del, C_7, PAPPAPPPRLLTRRLLSCRTPGPTRTRKRRRPISFPTETPC, (SEQIDNO:4677); XM_014116569.1, GLTSCR1, Ins, C_7, PAPPIPAPRGAAAPSSPPSSRLHLLWRGLHGYVHQAASPYAS, (SEQIDNO:4680); XM_005633023.2, TICAM1, Ins, C_7, PAPPLLVGPPASRRAAVAGRLARARLPARARLPAAPRLLAAPRAPAEPGAAAPHHPP RADGAAGRQQPHVEPARDPGARGRDARSRV, (SEQIDNO:4681); XM_014108769.1, ARHGAP22, Del, C_7, PAPPPAAGGTAGLPSWAVARTRRAPAAAAASPATQAARPRTTPAAPRLSGAWSRSS GHSCAGRGPSTTRVSKDLKKVVPA, (SEQIDNO:4682); XM_014121829.1, TMIGD2, Del, C_7, PAPPPRDVAPSPRACEASF, (SEQIDNO:4683); XM_014121831.1, TLE6, Del, C_7, PAPPRAPRKGAQSRAPELRACSPAWPRSLLGEPVHS, (SEQIDNO:4684); XM_005635893.1, LOC102152644, Ins, C_7, PAPPRCLLWGSGRNRRHKPLL, (SEQIDNO:4685); XM_014111158.1, LOC106558344, Del, C_7, PAPPRSRPPRSCSSPTPPALPRLRVSGTTCWPGKPRVALDAALGPPA, (SEQIDNO:4686); XM_005626204.2, SBF1, Del, C_7, PAPPRTRGLPSGPCPGIS, (SEQIDNO:4687); XM_003640056.3, RFX7, Del, C_7, PAPPTRGWLCQPWCLGCQGQRPARCNTRSRTPSAKLYNLKWTAF, (SEQIDNO:4689); XM_005615653.2, AKAP7, Del, C_7, PAPQALSAATQQATTAPPGA, (SEQIDNO:4690); XM_014121988.1, WIZ, Ins, C_7, PAPQEEPACPWALGTGGQSAEQQSGCRGSSWQQAGAARSQGPESDHLRGLRCL1, (SEQIDNO:4691); NM_001031818.1, COL4A4, Del, C_7, PAPQGDLEPLVLQVPQEELLKVTFLTQVHPEMWVLLAPMVREERPGPQAPPGALTF, (SEQIDNO:4692); XM_014109393.1, LOC100686862, Ins, C_7, PAPQPGGPPPPPPAARRRTAPLVAPLLRPAD- SLTPQQPGGNLRPGGRAGAPLVRSPPA LPGSPEAAGARRTARPRPARLRLGDPGLAR, (SEQIDNO: 4693); XM_005615881.2, LOC102155525, Ins, C_7, PAPQQDFVVCL, (SEQIDNO:4694); XM_014109869.1, COL18A1, Del, C_7, PAPRATPASR, (SEQIDNO:4695); XM_003433939.2, C30H15orf59, Del, C_7, PAPRPRWAPPSPRPPPASPGALR, (SEQIDNO:4696); XM_545640.4, RUFY4, Del, C_7, PAPRRERLSPT, (SEQIDNO:4697); XM_546635.4, HS3ST3B1, Del, C_7, PAPSPASSVGPGASSCRRPLSSA, (SEQIDNO:4699); XM_014110191.1, PIGZ, Ins, C_7, PAPSPPPRPGLVRGGGGHGWDRGLGPVPCPEQPHQTASLPGGRWAVALPPFCGDPW HHQACHREVPLPSQE, (SEQIDNO:4700); XM_014121412.1, NCKAP5, Ins, C_7, PAPSRQGRLPSHPA, (SEQIDNO:4701); XM_014108893.1, DOCKI, Ins, C_7, PAPSSSPEACSASTAQQDPTSASSEDDAQADVSGLRNRAV, (SEQIDNO: 4702); XM_014112392.1, MEF2A, Del, C_7, PAPTGNGALPCGQSEQLKQLL, (SEQIDNO:4703); XM_844754.4, PLEKHOI, Del, C_7, PAPTRCGPRTPPPSFRPTRPSCPGSRTIV, (SEQIDNO:4704); XM_005615500.2, SASH1, Del, C_7, PAPTRPACRLRRAAPVTVPPLRLLVPPQDRSPAARPAPDHRPGCQSSRRARASRSTAS SWARL, (SEQIDNO:4705); XM_014115764.1, PPP1R3E, Del, C_7, PAPTSPAT, (SEQIDNO:4706); XM_014111713.1, ATP2B3, Ins, C_7, PAPVPQPEQQRHRQRHLPEHARHQVSYLVSAFFQTGEPPPQRGDVPL, (SEQIDNO:4707); XM_014115996.1, PLEKHH1, Ins, C_7, PAPVSILGEPDLCCGHGWHAALRCIFQN, (SEQIDNO: 4708); XM_847792.4, IGFBP5, Del, C_7, PAPWAASWSKSPAAVAA, (SEQIDNO:4709); XM_540976.5, ARHGEF4, Ins, C_7, PAQGFQGCGSSLTCHEECGPAH, (SEQIDNO:4711); NM_001031815.2, HGFAC, Ins, C_7, PAQGSSLQQQPWGPSAHSGWAALQVPLPLWRPHAPRLHFRRKRPQEVVCHHSQL, (SEQIDNO:4713); XM_005627762.1, C12H6orf132, Del, C_7, PAQRTRPPQRLWTGGIPARWKSFGVSSRPISVAPGGRTDPSVTRQAQQRPFRRRRAR TAPACQRRRFLQACQRRRSSQALLRRVPAACQRRGLPPA, (SEQIDNO: 4715); XM_003431483.3, KIAA1644, Ins, C_7, PARAAHPAAPAPARPAATGAPGRAHTAGRRPQPTAHDLPELVRL, (SEQIDNO:4716); XM_014112352.1, LOC102153630, Ins, C_7, PARAGGRQGVRSSREERQQESGRGKARERALTFGGAVLGAADEK, (SEQIDNO: 4718); XM_014121720.1, ARHGAP21, Del, C_7, PARAPGQALPQETQQPRSRRRRLRSRPRVVRRVA, (SEQIDNO:4719); XM_847443.4, GPN2, Del, C_7, PARARPRTAWA, (SEQIDNO:4720); XM_014114191.1, LOC106558877, Del, C_7, PARCPLRPRPVVPQAPARRPLRTLLPGPACQDPARRPQDPPARTCPPGTRPPGPGPPSP RTCPAAACSQHAPHPTWNPTIVGSLVTI, (SEQIDNO:4721); XM_547000.5, TNRC18, Del, C_7, PAREGRAATVAES, (SEQIDNO:4722); XM_005616615.2, RASGRP4, Del, C_7, PARGMAPTAEKS, (SEQIDNO:4723); XM_014107670.1, PER2, Ins, C_7, PARGRPARVWPPALAVRRPPGPGHGTGVTQLSPPRRAPRPAPGLLPRPA, (SEQIDNO:4724); XM_005636883.1, KMT2D, Ins, C_7, PARGTGQSAPCCCPHHFHWQPHNPRRLVYLCGRVPEAASGHSARPRLAR, (SEQIDNO:4 725); XM_014107872.1, VPS37B, Ins, C_7, PARILCTVHVSIPTRSSPETPAPAASTPARLHPPV, (SEQIDNO:4726); XM_014110134.1, ZP1D1, Del, C_7, PARLETPSSLLVPSLLGVTRLQPTIHSLALQMNLLSS, (SEQIDNO: 4727); XM_536512.5, PDZD2, Del, C_7, PARLPPQPHPPRGASRRAAARSPRPCPAPSCRS, (SEQIDNO:4728); XM_547886.5, TTC9, Ins, C_7, PARPPLGGAEQDGGSHRDRLLQQPGSVPAPG, (SEQIDNO: 4730); XM_014107107.1, RAP1GAP, Ins, C_7, PARPRGVQEGA, (SEQIDNO:4731); XM_014108204.1, CABIN1, Del, C_7, PARPSRASCPACQSWSSPRPPPSSPLRSPSRRPPQLCSHPKAASRRRPSRS, (SEQIDNO:4732); XM_014113201.1, MLLT4, Del, C_7, PARRARPPTASFSAPHSGPPWPEPTVLLTKQASPHPLQKNQASTSPATRKDQTLTWD LPGQLLAPTMPIGTREKDCLKATRQIYLGALEPLKT, (SEQIDNO:4733); XM_014116237.1, BAHCC1, Ins, C_7, PARRGRSP, (SEQIDNO:4734); XM_533642.4, CLASRP, Ins, C_7, PARRPRTGT, (SEQIDNO:4735); XM_014111220.1, ELK4, Ins, C_7, PARRQGLQPQRLYTLRLVFFLHSQLFELLQQEAFQTHKD, (SEQIDNO: 4736); XM_014109934.1, ADGRB2, Ins, C_7, PARRQGLRGSRAAD, (SEQIDNO:4737); XM_014117114.1, LEMD3, Del, C_7, PARRRPPPVHSGSITPTIRAPITRT, (SEQIDNO:4738); XM_014122095.1, DDA1, Del, C_7, PARSHGPIARTCMRT1, (SEQIDNO:4739); XM_005622278.1, PTPRC, Ins, C_7, PARTQQLRGASARLQHPGCQLLR, (SEQIDNO:4740); XM_005630838.1, LOC100685649, Ins, C_7, PASAAGETAMPASTPGAMCPQNQGAMPPQGSRALPHQDSRALPHQGSRALPAQGS RAMSLNSDSSTSSAEDQAEV, (SEQIDNO: 4741); XM_014113377.1, PHLDB1, Ins, C_7, PASARQSFPAAAGLPLQDGW, (SEQIDNO:4742); XM_005631006.1, COBL, Ins, C_7, PASATPTPTLPSS, (SEQIDNO:4744); XM_005618001.1, FBXO6, Del, C_7, PASATSSSTEARTRSSGRAGTGPASPTAASSLALR, (SEQIDNO:4745); XM_540770.5, PIDD1, Del, C_7, PASGVAGRWLSGP, (SEQIDNO:4748); XM_014122286.1, MAP1S, Del, C_7, PASGVGRPAPQQRSIVPQLPSWWPHPARRAAWSWG, (SEQIDNO:4749); XM_847877.4, NUTM2F, Ins, C_7, PASLHSRVGLRS, (SEQIDNO:4750); XM_005642137.1, LOC102156225, Ins, C_7, PASLLPPGPGGHRLQQCQDETHPCPD, (SEQIDNO:4751); XM_014107876.1, USP30, Ins, C_7, PASPDALPAPRGS, (SEQIDNO:4753); XM_014114724.1, CACNA1H, Del, C_7, PASPLSPPGRTRVRPGPRRQRAAPPLCGGEPRPARPCRTGTPSSPWRGPGWTLPPRAT GGPRPLAA RNT, (SEQIDNO:4754); XM_861806.4, SF1, Del, C_7, PASPPPFPGPKGASSRGHRLLPGLGRGCWCPGSRRPRPWARWEP, (SEQIDNO:4755); XM_005619870.1, SMTNL2, Ins, C_7, PASPREPLLGAASSACHGHHSDA, (SEQIDNO:4756); XM_014116482.1, SOCS7, Ins, C_7, PASPVSALPARLKQLCSQPSRVGEVWLVLGTNELGRCRDEAEREARWLFPGTR, (SEQIDNO:4757); XM_014108893.1, DOCKI, Ins, C_7, PASQREHGRLWKLDGKPGFDQLAHPPAPSSSPEACSASTAQQDPTSASSEDDAQAD VSGLRNRAV, (SEQIDNO:4758); XM_542121.5, LRRC8E, Del, C_7, PASRSWCTCRSSACSTRLPGCPSRCRSSCGTA, (SEQIDNO:4759); XM_014109357.1, NUTM1, Ins, C_7, PASSILCREPSGALCSP, (SEQIDNO:4761); XM_005636179.2, SETD1B, Ins, C_7, PASSTPTSTPC, (SEQIDNO:4762); XM_014117497.1, FER1L5, Del, C_7, PASSWFGVKKRTSLKSAWCGCTWSEPSTCSPKIPMACATLM, (SEQIDNO:4763); XM_014109643.1, C30H15orf39, Ins, C_7, PASTLTRPQAGAASRSPVPLGLCPPDAELSLRPG, (SEQIDNO:4764); XM_543973.5, SEMA4G, Ins, C_7, PASTTPTPTG, (SEQIDNO:4765); XM_545954.4, KLF3, Ins, C_7, PASTVARESSISHSTTREETFACGVPGHPAETKDTQM, (SEQIDNO:4766); XM_014113666.1, RAI1, Ins, C_7, PATAPARGRGQI, (SEQIDNO:4767); XM_014114530.1, LOC100856086, Del, C_7, PATASPRIQKMGTSVALGCLGRQGKAQFPENQSQISQRLWWVQGLRKLVWVL, (SEQIDNO:4769); XM_014117108.1, LOC106559343, Ins, C_7, PATEGGGAGPRGPGPLGWEGGAGGPRLRAVRTRVTLRAAGPGRATGGAREAPPSPA RLPAPLPA PLRPG, (SEQIDNO:4770); XM_014117262.1, TUBGCP6, Del, C_7, PATERSPTSRRPAGTPSTGSAGSAEGSCRRSAGACCRSRSPCW, (SEQIDNO:4771); XM_014113517.1, DVL2, Ins, C_7, PATGEDQRHRG1, (SEQIDNO:4772); XM_014111179.1, SOX13, Del, C_7, PATGPPRGTCRPARPACP, (SEQIDNO:4773); XM_014112912.1, ARID1B, Ins, C_7, PATPHQKGDHLSSWLSRGVAASLETKAEDYLKRYRYS, (SEQIDNO:4775); XM_014112341.1, ADAMTS7, Del, C_7, PATPLSAMCSAATLTPCSTRASCTRGCLWSTTRTPASCTAGPPMSTLLRSFGTL, (SEQIDNO:4776); XM_543867.5, PRMT8, Ins, C_7, PATPSTRRPNQACAMCPSCVHSTQLPRTG, (SEQIDNO:4777); XM_014108204.1, CABIN1, Ins, C_7, PATQAGGHPQHGLSGPRGRRAGRRGGGHGLPAPGAPAQ, (SEQIDNO:4778); XM_014114743.1, AXIN1, Del, C_7, PATQTWAAWDCGTHTRRTPRASWMSTCSGS, (SEQIDNO:4779); XM_014106880.1, RBBP8NL, Ins, C_7, PATRQEQPPQPTLRAQPPPGQLPAGLPAPRHGL, (SEQIDNO:4780); XM_540754.4, AMBRAC Ins, C_7, PATSALFLPCPCPSPPSWHRRTNAALRPDQQQPPC, (SEQIDNO:4781); NM_001006650.1, PKD1, Del, C_7, PATSTSSFQSRPQA, (SEQIDNO:4782); XM_014106904.1, MMP15, Ins, C_7, PATTPRWEARATPEARPPSPAPSHGTA, (SEQIDNO:4783); XM_014122369.1, FBN3, Del, C_7, PATTSMGTPAPVRTSTNALHTRASVALVPATTPWGTTPVSALQSTCKSTVATTAWT, (SEQIDNO:4784); XM_547926.3, TMEM63C, Ins, C_7, PAVFGDHHRQILLLEGCPGPTP, (SEQIDNO:4785); XM_848382.3, EBNA1BP2, Ins, C_7, PAVGFGLGI, (SEQIDNO:4786); XM_014111404.1, FRMPD3, Del, C_7, PAVGREGWRPAWGGPRSAWEGRKLA, (SEQIDNO:4787); XM_005616615.2, RASGRP4, Del, C_7, PAVLARTCCICSRFPWISSTRRMRSMNFLTLENPAVPRVCHPPPSRHPWWWSGPLA, (SEQIDNO:4788); XM_845641.5, EPN1, Del, C_7, PAVLGHST, (SEQIDNO:4789); NM_001003150.1, MT4, Del, C_7, PAVPSVPRAASAKEARTSAAAVP, (SEQIDNO:4790); XM_014107132.1, PMEPA1, Del, C_7, PAVTRASAPRATGAVGAWRGRPPPTARSSATTRGPRPSSTSRAAGRPPCWRGPGSPT HTSPPWRAQLPGAKKRINRKGTLS, (SEQIDNO:4792); NM_001048091.1, OAS3, Ins, C_7, PAWAGTPDGVRLGAGWAERPVQHGPGLPHRPGAGQPVPSAPCLLDCQLR, (SEQIDNO:4793); XM_547068.4, TBX6, Ins, C_7, PAWDRFQLPACPGRGLPLP, (SEQIDNO:4794); XM_847455.4, CHRNB4, Ins, C_7, PAWPAAAQQDRGRRPPALWEPRVPCEPHACGPQVPSGLGLWRGVHGL, (SEQIDNO:4795); XM_540513.4, NLRP6, Del, C_7, PAWSSLWL, (SEQIDNO:4796); XM_005631651.2, LOC612278, Del, C_7, PCAAHISLLPPFPSQLGPQPCCLSTSSGIFSILLSSGRSGWTWPG, (SEQIDNO:4797); XM_005640656.2, ZNF142, Del, C_7, PCAAPSATLRAATSWCSITT, (SEQIDNO:4798); XM_005618689.2, GAK, Ins, C_7, PCAGQWGSPQHRRPAQPPPGGP, (SEQIDNO:4799); XM_541775.4, PRRT3, Ins, C_7, PCAGVPCGGC, (SEQIDNO:4800); XM_014110586.1, RREB1, Ins, C_7, PCAHPGPRGAPRRGGAARGRAGAGSR, (SEQIDNO:4801); XM_014116569.1, GLTSCR1, Del, C_7, PCAPHPSPQRGRCPQLPTFLPPPPPLARPPRIRPPGCQPLRQLTSSSSFRLARENTSPPRP LRPSTCSLSPLRPPHRLLGPSRW, (SEQIDNO:4802); XM_014120830.1, UPP1, Del, C_7, PCARSLFLSLPSQ, (SEQIDNO:4804); XM_003431951.3, HIVEP3, Ins, C_7, PCASAEKPLNAFCHLHPQYPPPHLPR, (SEQIDNO:4805); XM_850293.5, UCKL1, Del, C_7, PCCAPASAPSTRP AGRPGTTSTARSPRRPLPLAWAVAAPRGRPPWPG, (SEQIDNO:4806); XM_005618371.1, MAN2A2, Del, C_7, PCCVSPKALSSRRWWHTTSIFARWSGYIICQGWRGCLWTCRPWWTSGITSTRSWPC ASTQTLTARVPSSRTSMAFRCSPGAI, (SEQIDNO:4807); XM_541567.5, PPP1R37, Ins, C_7, PCFILPTPLTCPTTS, (SEQIDNO:4808); XM_014117254.1, NCAPH2, Ins, C_7, PCGGGSRTETQEEGCHQAAGLSPVVPGCLR, (SEQIDNO:4809); XM_531841.5, B3GNT2, Ins, C_7, PCGLLEQRTRKAEQAVQSHFEHVGQPDGRSIRVFQHKPSKFL, (SEQIDNO:4810); XM_542327.5, INPP1L, Ins, C_7, PCGRGELIR, (SEQIDNO:4811); XM_540754.4, AMBRA1, Del, C_7, PCHLCPLPPLSLPLSPFLAPKDQRCTAT, (SEQIDNO:4812); XM_005639159.2, AFF1, Del, C_7, PCHLYIPTSKLFPGHKEAARFTAVTVIVKAIAQPNLPKT, (SEQIDNO:4813); XM_014117046.1, GARNL3, Del, C_7, PCHPHRC1QTTRNSGTFC, (SEQIDNO:4814); XM_014113517.1, DVL2, Del, C_7, PCHRRGPAASGTLGLRPSTLTCPAAGRTWSLRRKPSQWCPCGGNGLVGETAGATGL VDPRGWSATWPGMRAPQPL, (SEQIDNO:4815); XM_014113516.1, DVL2, Del, C_7, PCHRRGPAASGTLGLRPSTLTCPAAGRTWSLRRKPSQWCPCGGNGLVGETAVSTVG ATGLVDPRGWSATWPGMRAPQPL, (SEQIDNO:4818); XM_014117542.1, BCL11A, Del, C_7, PCLAHHRDITWTPTA, (SEQIDNO:4821); XM_005639078.2, SCARB2, Del, C_7, PCLCMPSSISSMSPIQRRSSEGRSLG, (SEQIDNO:4822); XM_005630709.2, BCL9, Ins, C_7, PCLGVCCCFACSPQVSITSCPVTWMDLLSKTSPSESRDPSKP, (SEQIDNO:4823); XM_014119889.1, BRAF, Ins, C_7, PCLIAWLTH, (SEQIDNO:4824); XM_544610.5, THBS1, Del, C_7, PCLMTSSKT, (SEQIDNO:4825); XM_014109357.1, NUTM1, Del, C_7, PCLQHSLQGTLWCSLLSLAHCW, (SEQIDNO:4826); XM_014108893.1, DOCK1, Del, C_7, PCLSKGAWQIMET, (SEQIDNO:4828); NM_001284465.1, PSEN2, Del, C_7, PCLVTQGTNWRKRRKGA, (SEQIDNO:4829); XM_005620526.2, UBE4B, Ins, C_7, PCPCGWPDGCALHFPQPAWWHGLWNCHRKPALLSTVSPLHCHPPVGVFDFSYPAIP RHLHSVQLAQPPCPC, (SEQIDNO:4831); XM_844466.4, MAZ, Ins, C_7, PCPGRRPPATAHLL, (SEQIDNO:4832); XM_014112777.1, LOC102154969, Del, C_7, PCPLPPCPPPGAPRARIPSSPAGLQRAHLAPG, (SEQIDNO:4833); XM_014109155.1, ADAM8, Del, C_7, PCPMWSSTRWCGPDVCQRPEPAEPCPPTWTCTQRV, (SEQIDNO:4834); NM_001205203.1, MEF2B, Del, C_7, PCPNSPLGTLGPVI, (SEQIDNO:4835); XM_846117.4, ST5, Del, C_7, PCPPPQPHQSLGDPRRTCVVTASPRAENPLSLRMHPVSSPCTPLLPLRMVLRANPSLD PKAL, (SEQIDNO:4836); XM_547500.5, KIF26B, Del, C_7, PCPPPTARSPRRAGRTAAAAATAATTAAC, (SEQIDNO:4837); XM_014109374.1, PYGO1, Ins, C_7, PCPPSEATNRQLIFLGFKRRHCRTQKK, (SEQIDNO:4838); NM_001204405.1, ARHGAP8, Del, C_7, PCPPSSLASVCSTSRTKIKVNSSLLS, (SEQIDNO:4839); XM_005631472.2, RE1A, Ins, C_7, PCPQDHPSRGR- DADRGPATAAV, (SEQIDNO:4840); XM_005630688.2, NOTCH2, Ins, C_7, PCPSPCSACTVLL, (SEQIDNO: 4841); XM_003431813.2, GLI4, Ins, C_7, PCPVPCQSCITRDTWTPPQRGPASPARSSTRLPWLQP, (SEQIDNO:4842); XM_005628022.2, GLI4, Ins, C_7, PCPVPCQSCITRDTWTPPQRGPASPAR-SSTRVSGCQNHGSSQCLVDAHGLPWLQP, (SEQIDNO: 4843); XM_005628021.2, GLI4, Ins, C_7, PCPVPCQSCITRDTWTPPQRGPASPARSSTRYSP-CAALPPPPPTTGTAGWTRGSSLAT GAPAPLHWGRAAGSSG, (SEQIDNO:4844); XM_014117947.1, KIF12, Del, C_7, PCPWGPRTHHQC, (SEQIDNO:4845); XM_014107670.1, PER2, Del, C_7, PCPWTPGTSLASSPRRSPSPWPRSWHWCYPTIP-SPPCPPACPRPSSPASLTFCRT, (SEQIDNO:4846); NM_001097547.2, PADI6, Ins, C_7, PCQGGRERVP-PRQDPHWQLLLPQQGGPRHEQGPPGLPLRPASPGPG-GALLGLADGG PHG, (SEQIDNO:4847); XM_005642137.1, LOC102156225, Del, C_7, PCQPPAS-WPGRPSPAAMSR, (SEQIDNO:4849); XM_014107876.1, USP30, Del, C_7, PCQPRCPSRSPWFLTTAPPCTSSG, (SEQIDNO:4850); XM_005618215.1, LOC102151979, Del, C_7, PCQRAPPTQSPMHLQARYRGTLHPQPLN-PALPTARLLSRSRHPHLDCPAPPSAWKQV CVPSWWTGVLG, (SEQIDNO:4851); XM_856804.4, PHF21A, Ins, C_7, PCQRRHLYAGPLPLLPELHSELYPG-GRD, (SEQIDNO:4852); XM_014113768.1, ACOTL1, Ins, C_7, PCQSPRQYLWGPDHGLDGERGHHCSQPAVPCP-PYAEGH, (SEQIDNO:4853); XM_014107107.1, RAP1GAP, Del, C_7, PCQTPRCSGRGLSSRNFC, (SEQIDNO:4854); XM_014115692.1, LOC100687926, Del, C_7, PCRAAPALGQRAPLRPQPGPAGELPAPRRR-WASLSALALGRPHPSAASICPLASPHQ ARQWKLCAGGWEMYILQTAAARMSSLHVTSLL, (SEQIDNO:4855); XM_014112423.1, KIF7, Ins, C_7, PCRCRRRRRRPPGRRVRALPGPHRRRLQPPARAAGR-ARAARRRRPQSARLAVRRGG RAQRPELRL-WAGQRHRERFRRGAGHAGARRAEGGQRPG, (SEQIDNO:4856); XM_539044.5, BACH2, Ins, C_7, PCRGHLPGEIQERVLPLLSKVSIQHKK, (SEQIDNO: 4857); XM_005622192.2, ELF3, Ins, C_7, PCRHLWSR, (SEQIDNO:4858); XM_005623751.2, BTBD7, Ins, C_7, PCRNHVYRSGLFCGLPSTLAPTTTSIPPPSHPNP, (SEQIDNO:4859); XM_005620011.2, VAMP2, Ins, C_7, PCRPGWGGRPPGAPSKPHQ, (SEQIDNO:4860); XM_005633153.2, SBNO2, Del, C_7, PCR-PRCAGPVSRTPCCTAPGGVPSRPRRTQPSPAKATSS, (SEQIDNO:4861); XM_539694.5, NAV3, Ins, C_7, PCRQTEAPCLGGGQNNFFRTEIHA, (SEQIDNO:4862); XM_005625430.2, NPDC1, Del, C_7, PCRQYRCTFPPWSPGAGAVTDSSSCSSWRAR, (SEQIDNO:4863); XM_005626845.2, LOC102151424, Del, C_7, PCRSLKSPGSKPEYMSGTLAFSSQAE, (SEQIDNO:4865); XM_852361.4, TCF20, Del, C_7, PCR-TRQRKAASAQSSRSGG, (SEQIDNO:4866); XM_005640017.2, RREB1, Del, C_7, PCSCQSPP, (SEQIDNO:4867); XM_014122286.1, MAP1S, Del, C-7, PCSCRRLRAYASSWSMWQSPWSHHLPLSCLSRRHL-WASSGSPGPAATSSLAASAMQ PSSLSMAS-QCWSMVAPTPSRAFGSWCGTWTGWMLCW, (SEQIDNO:4868); XM_543063.4, FAM210B, Del, C_7, PCSCRRSGAGPTLCCCARSAGTAAAART-PAKSLRQQAGLSAADRRKSKASHSS, (SEQIDNO: 4869); XM_005638086.2, RALYL, Ins, C_7, PCSDS-TEASQSGCHNDSQGKRSLFHERGIENRQWVIFIRL, (SEQIDNO:4870); XM_540605.4, OR10C10, Del, C_7, PCSNWPAQTPP, (SEQIDNO:4871); XM_014107411.1, WASF3, Ins, C_7, PCSRGKAPGDGTATHK, (SEQIDNO: 4873); XM_005618215.1, LOC102151979, Del, C-7, PCSRRSPGPWPCTPSRGL, (SEQIDNO:4874); XM_854764.4, MAP1A, Ins, C_7, PCSYPPEQRPKPPSEW, (SEQIDNO:4875); XM_014115996.1, PLEKHH1, Del, C_7, PCTGFHPGRAGSMLWPWLACGSQMHLPELMSPAV-LQALLPLRPLGLSLALSTRMSP CLSTQP, (SEQIDNO: 4876); XM_014111738.1, MAP7D2, Del, C_7, PCTLSDPVRISAWMTVTKT, (SEQIDNO:4877); XM_014110953.1, STK36, Ins, C_7, PCTSGKPDHPGL, (SEQIDNO:4879); XM_541489.6, MED25, Ins, C_7, PCTTWGPIHGGHGGPRWGEWPCPGAAGGPGPW-GAAVSVQQTPGLERGPRMAGEA QTCLRGRQHQA-DAIAALPGLCESRRELKD, (SEQIDNO:4880); XM_005637917.2, COR12J1, Del, C_7, PCWCSPAPPRS, (SEQIDNO:4881); XM_014111079.1, UBR4, Del, C-7, PCWTSHLMQMTRPWLN, (SEQIDNO:4882); XM_003433475.3, NTF3, Del, C_7, PCWVVAAAGWGGL, (SEQIDNO:4883); XM_005631006.1, COBL, Ins, C_7, PDAAAPDVQPP-GAASHSGQGGKQEERHGCWTAGATKASQRHWP-GAPPASATPTPT LPSS, (SEQIDNO:4884); XM_014117000.1, HMCN2, Ins, C_7, PDAARPAG-PEGAGRRDSGPELHGRGQPGAPAEL-VQGRGGPAGWGA, (SEQIDNO:4885); XM_005633780.1, LOC102154018, Ins, C_7, PDASFPA-SIS, (SEQIDNO:4886); XM_014117415.1, SHANK3, Ins, C_7, PDCAATPTSPLLLRLGAAPRLLASAAPGPRLRH-CALQL, (SEQIDNO:4887); NM_001003291.1, ICAM1, Ins, C_7, PDCGSGHTVVCGLHSGWGVPSFGGPSPPGVSR-REAALHSPVQKGLPLGHGKCQSKP RRRGYPAAMV, (SEQIDNO:4888); XM_005620586.1, ZCCHC14, Ins, C_7, PDDGRSLSPSAHPDAEFGAQVGKRGCGHEAP-PAFRALAAVSRRKE, (SEQIDNO:4889); XM_014106404.1, KIAA0226L, Del, C_7, PDFKSYLM-FIHHSRGISW, (SEQIDNO:4890); XM_542033.5, IER2, Ins, C_7, PDGAAGVRGEAGLPPRGQHAER-ARAGRGGFL, (SEQIDNO:4891); XM_005640052.2, JARID2, Ins, C_7, PDGARPGGEGPAQRAREEGRARAE-PRKEPAEAGHGRQERAGQTSTRQGGQRLL, (SEQIDNO:4892); XM_542234.5, MAML2, Ins, C_7, PDG-LPSSRRHSPTAPARLSPSPPAAPAQQWQ, (SEQIDNO: 4893); XM_005641756.2, LOC102154914, Ins, C_7, PDGSAERGTAAGPRGAGGPAALRAL-GANATLPLGVPSPESEASGSGR, (SEQIDNO:4894); XM_005630474.2, POLR1A, Ins, C_7, PDGVWQITALL, (SEQIDNO:4895); XM_543042.5, KCNB1, Del, C_7, PDHLRNTQQ, (SEQIDNO:4896); XM_005632766.2, WIZ, Ins, C_7, PDITGQVCWQHLHPQVQVL, (SEQIDNO:4897); XM_533117.5, FDXR, Ins, C_7, PDLCGGQWTRWLLYRPTLAKAPPPGPCGHL-REAACAFRPGALWRGA, (SEQIDNO:4898); XM_005620633.2, C5H16orf74, Ins, C_7, PDPHGHDAATGLQADSLAG, (SEQIDNO:4900); XM_014116841.1, DPH1, Ins, C_7, PDPQAA-PAGEGGVHVPLSSRGLRRLQLRRRKGSAAGSV, (SEQIDNO:4901); XM_014106445.1, COL4A2, Del, C_7, PDPQALQDK, (SEQIDNO:4902); XM_003433444.3, HIC2, Ins, C_7, PDPRRPGPVE, (SEQIDNO:4903); XM_014122282.1, TCF3, Ins, C_7, PDPVQPGRGR-GRPSPPRAEG, (SEQIDNO:4904); NM_001170829.2, SMAD3, Ins, C_7, PDREAPAGLEEGRAERAG-GEVVREGGQEFGQEAQEDRAVGRAGEGHHHAER-QHQV HHHPQVPGWPAAGVPSEGAPACHLLPP-VAMARPAQPPRAAGHGAV, (SEQIDNO:4905);

XM_848173.4, ZFHX4, Ins, C_7, PDRLGPRHTARPSGCFPQKETGRQGGHGLQ, (SEQIDNO:4906); XM_014116531.1, LOC106559282, Del, C_7, PDRPPGNPNLRPPPRAPG, (SEQIDNO:4907); XM_847025.3, FADS6, Ins, C_7, PDSHDEPGRAEL-AAAACAGLGLWPLHHQLPRGASLLPPAL, (SEQIDNO:4908); XM_014109943.1, COL16A1, Del, C_7, PDSWDPRASREKQDT-LASQDQRVTVGNRVPQAAVVGPEQRVSLVPWDL-REDPAPQ ATLGLQGL QASQVLPGSLQWA, (SEQIDNO:4909); XM_014110892.1, SH2D5, Ins, C_7, PDTAAPGPCQVRGRAAGPGL, (SEQIDNO:4910); XM_014107733.1, FBRS1L, Ins, C_7, PDTAPAP-GAAGGQQPGHPRTPCRCQPVDLIQPANHVL-PASFGDSD, (SEQIDNO:4911); XM_005638000.2, PLAG1, Ins, C_7, PDTGSSGSCKHPRSQLPALSVSSIHQ, (SEQIDNO:4912); XM_014117336.1, MKL1, Ins, C_7, PDTQPLGSQ, (SEQIDNO:4913); XM_854174.4, BAG6, Ins, C_7, PDTSCGLGAGSLELSNIRSS, (SEQIDNO:4914); XM_014106445.1, COL4A2, Del, C_7, PDWA-CLAPKASVVSPEMPDYLDPQAFPAPPDPQALQDK, (SEQIDNO:4915); XM_014116315.1, LOC102152536, Del, C_7, PDYQGPSAGRLLVSLRPRIGVLGPPSMLSG-GRPGCT, (SEQIDNO:4916); NM_001003016.2, MCLI, Ins, C_7, PEAAAARAPLPRVAA, (SEQIDNO:4917); XM_014113960.1, FOXL1, Ins, C_7, PEAALQLHRAHSHGDPGRARAEGHPERHLPVHHG-PLPLLPRQPARLAEQHPPQPLA QRVLRQGAPRE-GAARQGQLLDAGPPLPGYV, (SEQIDNO:4918); XM_003639850.3, VPS16, Ins, C_7, PEADG-LVQPSSQQREGCRGGMGEASNGGG, (SEQIDNO:4919); XM_005633811.2, LOC102152567, Del, C_7, PEALPPGQNPRVARSTMHPRGPRSARARR-PARWPRPGRGGQAPLRVLLVRSKSGCL MATVSAVPARSSRPFIVSRCRSHRQF, (SEQIDNO:4920); XM_005636589.2, CLDN5, Del, C_7, PEA-PADPRLCQTRRGRGPEAVSRAPGRRGTRARSGR-PAAPPRHRRAPPRGPGAVGRP SRLQPWGRRRWRSSAWCCAWWAGWA, (SEQIDNO:4921); XM_855027.4, ATP2A1, Ins, C_7, PEARGDDS-GRLCQVHGI, (SEQIDNO:4922); XM_005636795.2, LOC486523, Del, C_7, PEASRRSPSTRISSLP, (SEQIDNO:4924); XM_003433503.3, LOC100683813, Del, C_7, PEASRRSRSTRAS, (SEQIDNO:4925); XM_014116790.1, FAM222B, Ins, C_7, PECDRVYLNYPPFNGGHPAAQPAPGPEQHRAP-DQPVLPDEGRHQHYLSV, (SEQIDNO:4926); XM_536304.5, SSBP2, Ins, C_7, PECFRWPR-NAWNEHGSRWW, (SEQIDNO:4927); XM_014116817.1, MYO18A, Ins, C_7, PEDLPGAQG, (SEQIDNO:4929); XM_014110056.1, LOC102151348, Ins, C_7, PEEA-CLLGTLQIPAPRHGRRPQLLLVLLLLL-FPSGQSRRWPFQDG, (SEQIDNO:4930); XM_014115768.1, SYNJ2, Ins, C_7, PEEEEEIGTRSLP-PAGAAEQQPAPPGPHLQHPKQRLAPCTPARPGCT-CAATCQPQCFL CHKPRN, (SEQIDNO:4931); XM_005629703.2, PAXIP1, Del, C_7, PEESHAPSTLF1, (SEQIDNO:4932); XM_005632488.2, VPRBP, Ins, C_7, PEFTSFAWTILCRQFPLDW, (SEQIDNO:4933); XM_005636540.2, ZDHHC8, Del, C_7, PEGL-CAACTQPPPAFSPVSRGLSGTPS, (SEQIDNO:4935); XM_843235.4, LOC607355, Ins, C_7, PEGPAQAPVH-PEPASAGARPFQPGPAHPGGRRAADDRA-HAQGDVPDHG, (SEQIDNO:4936); XM_539768.4, FHDC1, Ins, C_7, PEGPGARGPRLPPPEALGAGRAGQ-DARAPAEV, (SEQIDNO:4937); XM_014122618.1, DCHS1, Ins, C_7, PEGPGPAGCDTTGHQ, (SEQIDNO:4938); XM_014108446.1, PCBP2, Ins, C_7, PEGRDHPVPAQA VQFSSHLCRWSGLYHSRTVCH-STARFDQAAPVGNATVSFSHDAWQHRIQCRFGCIC SDYFS, (SEQIDNO:4939); XM_014108443.1, PCBP2, Ins, C_7, PEGRDHPVPAQA VQFSSHLCRWSG-LYHSRTVCHSTARFDQAAPVG-NATVSFSHDAWQHRIQWH, (SEQIDNO:4940); XM_014108440.1, PCBP2, Ins, C_7, PEGRDHPVPAQAVQFSSHLCRWSGQVQHRQRQCEL-SPHHPVHVPQP, (SEQIDNO:4941); XM_014108448.1, PCBP2, Ins, C_7, PEGRDHPVPAQAVQFSSHL-CRWSVDQAAPVG-NATVSFSHDAWQHRIQCRFGCICSD YFS, (SEQIDNO:4942); XM_014108447.1, PCBP2, Ins, C_7, PEGRDHPVPAQAVQFSSHLCRWSVDQAAPVG-NATVSFSHDAWQHRIQWH, (SEQIDNO:4943); XM_005619422.2, BASP1, Ins, C_7, PEGRGRAG-GRRRPPGRGARAGDPGRGRGGGAGPGARGTRKD, (SEQIDNO:4944); XM_014120647.1, FAM63A, Ins, C_7, PEGSDYIR, (SEQIDNO:4946); XM_541565.4, EXOC3L2, Ins, C_7, PEGSGRAPGPGGPSRK, (SEQIDNO:4947); XM_014112539.1, RGS12, Ins, C_7, PEH-PEKGLVQEGFRDAKHFRSPSTS, (SEQIDNO:4948); XM_005620748.2, ATXNL1, Del, C_7, PEKGLRGQCWDPESNVTVRGRASRQVRAPKW, (SEQIDNO:4950); XM_005618730.2, WHAMM, Ins, C_7, PELGGPALGRRAPRRAPAAGGALAAPGELL-PAVAARAGCARRRGLFSGARALGAR VDRAYGPR, (SEQIDNO:4951); XM_014111821.1, ELK1, Ins, C_7, PELPILPLRYTQPLSSELSALQVPLGWREHSASDG-PLCDAVAVSAAAAERARQWPHH LLDLTGWR, (SEQIDNO:4952); XM_548979.4, ELK1, Ins, C_7, PELPIL-PLRYTQVPLGWREHSASDGPLCDAVAVSAAAAERAR-QWPHHLLDLTGWR, (SEQIDNO:4953); XM_548855.5, WWC3, Ins, C_7, PELPLGHAFPSGLPRLA-LDPTGGHFRGARPGYP, (SEQIDNO:4954); XM_014113658.1, TOP3A, Del, C_7, PELP-SQLASPLTTCKLASPRTERTAPPGCCPCPPPPMGKVIL, (SEQIDNO:4955); XM_014119615.1, TEP1, Ins, C_7, PELRAAAAGDGDGPGRAGVRPAVRTWHRDGR, (SEQIDNO:4956); XM_014119781.1, HIPK2, Ins, C_7, PEN-PGQRSAGGM, (SEQIDNO:4957); XM_014109523.1, PML, Ins, C_7, PEPASCQPAGPEHLLQRPVGG-GRLRSGTRPLHPSHWPQLCKEGMPAEL, (SEQIDNO:4958); XM_014111149.1, SLC30A10, Del, C_7, PEPCLWPTSMA VRSTTAVPLWTRTQV-MASGGEKQQKWLLKYRWTAV, (SEQIDNO:4959); XM_014112349.1, BOD1L1, Del, C_7, PEPGLEAS-RGWKKPLRRRPSG, (SEQIDNO:4960); XM_854614.4, MBD6, Ins, C_7, PEPHLSPGAGACPASPQCLSPTPWFS, (SEQIDNO:4961); XM_853562.3, R3HDM2, Ins, C_7, PEPIHGPVESL, (SEQIDNO:4962); XM_546666.4, MAP2K3, Ins, C_7, PEPRLPDLHHHWR, (SEQIDNO:4963); XM_005620305.1, KMT2A, Ins, C_7, PEPTWLSQG, (SEQIDNO:4964); XM_014114088.1, AKT2, Ins, C_7, PEQLLCRRMPADED, (SEQIDNO:4965); XM_534128.5, TSC22D1, Ins, C_7, PER-CDQWERSSSPPPSPPSHSSRAPPPPRAPP-SIPCRRGQSTHSRRATLQPGIQKTLCPW KRRQRCTSCTDFCCIIGRLTCIRND, (SEQIDNO:4966); XM_005621574.2, RBFOX1, Ins, C_7, PERH-PRGVHGPSPPPRSGVHGPDHRPRAHVKPVPSRPDTL-GAERRGHQRADRVRHR HTDR, (SEQIDNO:4968); XM_005635260.2, OSBPL2, Del, C_7, PERMGFRNT-GRHCPPRCLPEVISVCGVY, (SEQIDNO:4969); XM_014111415.1, LOC612200, Ins, C_7, PERNRGGSRGHWRCHRASTP, (SEQIDNO:4970);

XM_537319.5, ZBTB14, Ins, C_7, PESGGRQVAHD-DAQGSGGNLERAGE, (SEQIDNO:4971); XM_014112876.1, CDH23, Ins, C_7, PESHQQCHSVCE-PLGPQ, (SEQIDNO:4972); XM_014111484.1, LOC100684337, Ins, C_7, PESSEGLPLPQCPGRPSLEPV, (SEQIDNO:4973); XM_014106445.1, COL4A2, Del, C_7, PESSGFLGSQEVGVTRELQGEQAFTAR-WAPQGTLVTVETS, (SEQIDNO:4974); XM_533443.5, UST, Ins, C_7, PETPVLYSNSTGN, (SEQIDNO:4975); XM_014117999.1, COL27A1, Del, C_7, PETSAPKAS-RALGGPLA, (SEQIDNO:4976); XM_014109686.1, SYNJ1, Ins, C_7, PETTSTFRG, (SEQIDNO:4977); XM_014109683.1, SYNJ1, Ins, C_7, PETTSTF-STQKPWNNTERYYRTQSAFTSSRIHRPRT-CWIQCSQTDCSTPCRSDQCPPEP CSGICWKIDS, (SEQIDNO:4978); XM_537502.5, SIPALL1, Del, C_7, PEVKVLTI, (SEQIDNO:4979); XM_848975.4, SLC18B1, Del, C_7, PEVMTLWEIQERHPDSFPENSSLY, (SEQIDNO:4980); XM_005627563.2, LOC102154910, Del, C_7, PEVSASLLLGLDPQREGTTPLRRSMPPAHG, (SEQIDNO:4981); XM_005638369.2, SPATA5L1, Del, C_7, PEWARPSWCGRWPGKPARSCWP, (SEQIDNO:4982); XM_014116906.1, EXD3, Ins, C_7, PFEDGPSRC, (SEQIDNO:4983); XM_843127.2, SH2D4A, Del, C_7, PFHPSRSSCTQRGPLGSLSEPRE, (SEQIDNO:4985); XM_014115375.1, EFNA4, Ins, C_7, PFIFVGASTVPF-HAGPRTCYLQGHSFQASAELGPWDRSEEPR-ARAGRRPL, (SEQIDNO:4986); XM_005638951.2, LOC102156742, Ins, C_7, PFILHLLRTCRGPRPSCSR-PRPSGTARPRPPLPLEVQRVPELPAAS-THRLRLLPNQLGR LPRAASTDSTDPL, (SEQIDNO:4987); XM_005628998.2, CC2D1B, Del, C_7, PFLAWRPLWAPRKMRWQLL, (SEQIDNO:4988); XM_005640394.1, LOC102151535, Ins, C_7, PFLLPLVNLSHPYVFVFL-STLGPGDPRVSRAVPLLGGHGARVPAAASAGGTG-WAQA AARV, (SEQIDNO:4989); XM_846233.4, PPFIA1, Ins, C_7, PFLPKIAPLRQAAQRSTAHSQPR-RHQGCQKLHRLTGWPREQPQQQ, (SEQIDNO:4990); XM_014116949.1, KCNT1, Del, C_7, PFLQRERENGSN-LAFMFRLPFAAGRVFSISMLDTLLYQSFVKDYMISI-TRLLLGLDTT PGSGYLCAMKVT, (SEQIDNO:4991); XM_014118001.1, PHF19, Ins, C_7, PFLSPQSVAS-RVPAAEKASL, (SEQIDNO:4992); XM_861806.4, SF1, Del, C_7, PFPGPKGASSRGHRLLPGL-GRGCWCPGSRRPRPWARWEP, (SEQIDNO:4994); XM_005619930.2, MINK1, Del, C_7, PFPRPPPGL-RAPFPKLRLCRGRWSPRRDRTRAWWHTGSH, (SEQIDNO:4995); XM_005621048.2, PILRA, Del, C_7, PFPRRAPRRRPYTLS, (SEQIDNO:4996); XM_014118308.1, PRRC2A, Ins, C_7, PFPVHPHSRCGSSSHPGEWWWQYQ, (SEQIDNO:4997); XM_005621064.1, LOC100686271, Ins, C_7, PFQDEPPGGDPILYPKGL, (SEQIDNO:4998); XM_014106445.1, COL4A2, Ins, C_7, PFQHVWVTW, (SEQIDNO:4999); XM_532077.5, ABHD16A, Ins, C_7, PFQLLGYVLSTPCLGEAC, (SEQIDNO:5000); XM_014109393.1, LOC100686862, Ins, C-7, PFQLRPAE-PGGSSHAPSPALWEPRPRPPQLRVRRGWAA, (SEQIDNO:5001); XM_844902.3, IL21R, Ins, C_7, PFQRDCDLLGTL, (SEQIDNO:5002); XM_545122.3, GPR156, Del, C_7, PFRALYLPTWGIVQI-GLCLGCAAGG, (SEQIDNO:5003); XM_545710.3, USH2A, Ins, C_7, PFRLPTLTTLPQCVLGGARGECNK-RRSCGV, (SEQIDNO:5004); XM_014106920.1, ZHX3, Ins, C_7, PFRQTPGLAPDPRLHANQVQ-GASPRAAQSPGEQFCAEPSSSRRRAGPPEDGNQDDPE RDRQLVLREAEESGCRGHQEG, (SEQIDNO:5005); XM_005624366.2, FMNL1, Del, C_7, PFRSPRISRS, (SEQIDNO:5006); XM_014118198.1, ZNF581, Ins, C_7, PFS-DRPVSRTWTFLIHRTAPDFLLSEAQPLPAH, (SEQIDNO:5007); XM_014113657.1, SOGA3, Ins, C_7, PFSIRVRGQSRGPRRQEPRKRGSGGRRRRRRGGL-LEGRMPAV, (SEQIDNO:5008); XM_849796.4, TCF7L1, Del, C_7, PFSPGPSPSGPCPQLC, (SEQIDNO:5009); XM_547550.5, FAM189B, Ins, C_7, PGAAASSPGSCAATAAAASVPQ, (SEQIDNO:5011); XM_014120815.1, GRB10, Ins, C_7, PGAAFAARAH-RRRQTPAGRRPAAQNLVSAGHPQPLPRALRPREPA-GADARLPTSRP GSCQAGCENLQ, (SEQIDNO:5012); XM_014110719.1, SCN9A, Ins, C_7, PGAAGEWEDAQCRGLQWCGLPG, (SEQIDNO:5013); XM_014111821.1, ELK1, Del, C_7, PGAANTATALH-TASQL, (SEQIDNO:5014); XM_548979.4, ELK1, Del, C_7, PGAANTATALHTGTPGMA, (SEQIDNO:5015); XM_014117449.1, LOC102154536, Ins, C_7, PGACAVRPILVGPV, (SEQIDNO:5016); XM_005628902.2, PABPC4, Ins, C_7, PGAEADAGRTFVPTHPNHAFKPGW-KNHRHAAGDRQL, (SEQIDNO:5017); XM_014114924.1, LOC607201, Del, C_7, PGAG-MASGCGFTAWGP, (SEQIDNO:5018); XM_846422.2, LOC609208, Del, C_7, PGAGPAAPGAPRSRATC, (SEQIDNO:5019); NM_001131049.1, DNM1, Ins, C_7, PGALAPQPRPARGPQPIGSGKSVPS, (SEQIDNO:5020); XM_005624466.2, KCNH4, Del, C_7, PGALLPGSSPSFSFPHWEPLDLRTSVPG, (SEQIDNO:5021); XM_540897.4, CHRM1, Del, C_7, PGAL-PIQSRGPRGKGASEQARARRPEGRSSWPS-GRPSRWSRKRRRLGP, (SEQIDNO:5022); XM_005621146.2, SDK1, Ins, C_7, PGAPGAPGRSD-CAQPPAPVGPGQRRGLPHSLLHGAGARAAPRR-VADLLLVHQPRGH SLRCRKAEALHFLQAAPESHQ, (SEQIDNO:5023); XM_005637678.2, WBP1L, Del, C_7, PGAPRARRAVPCLGPAEAARDPQASLTLSPPTCP-PAQQPPKPPGWSPVALWLAWGS WTLGPSWT-KIPTVRRSC, (SEQIDNO:5024); XM_537028.5, WDR77, Ins, C_7, PGAPRGPRVEPPP, (SEQIDNO:5025); XM_014122482.1, LOC102152187, Ins, C_7, PGAPSPPGSGSPRVRPSVGPLAAPRDMA-FIWRNRLLSF, (SEQIDNO:5026); XM_003639997.2, CALHM3, Ins, C_7, PGAQRPRRPGWRRWRQGPPAG-GLQPGAGGPPPEHVVLQQTTARPRGIPWAPGGWP QPPSRHGGPGHQAAPAH, (SEQIDNO:5028); XM_014106443.1, MYO16, Ins, C_7, PGARGGR-GRQSNGGGRPRRAQGAAAGLRARGRPGRPPPQG-PLLPREGSQGRALEGQ RRAPQRRF, (SEQIDNO:5029); XM_536262.5, TBC1D1, Ins, C_7, PGARGRPLLGR, (SEQIDNO:5030); XM_003434673.2, C5H1orf233, Ins, C_7, PGARRARRVRGVRSRAGRHAGDRSGHDGG-GRLHLRHAGGHLPARGLHHREPHAPS FRAPR-PAQAAL, (SEQIDNO:5031); XM_536856.5, PLOD3, Ins, C_7, PGASGCVCRTIYPIPAPLPAAAAAPGLPP, (SEQIDNO:5032); XM_546739.5, MEGF6, Del, C_7, PGASGLAVSSHVGVSTGAPVMQPLGPA-SALLGSWGPTAVCPVHRATSAPAVRMCA GVGRP, (SEQIDNO:5033); XM_014118655.1, ZC3H3, Del, C_7, PGATIGLRRGRASPLVGSGNPQSQEESR-GAAVQRTPFWSARRSPASPGW, (SEQIDNO:5034); XM_543528.4, SUSD2, Del, C_7, PGAWTGCAPCK-PAPGSPPASSAATRRPAACS, (SEQIDNO:5035); XM_014107254.1, GMEB2, Ins, C_7, PGCFRQLSSLAPA-RGLHSAGLVGHHLS, (SEQIDNO:5036); XM_536856.5, PLOD3, Del, C_7, PGCFWLCL, (SEQIDNO:5037);

XM_005620448.2, CHD5, Ins, C_7, PGCLQLPLAGAGP-PREEREGV, (SEQIDNO:5038); XM_003639660.3, B4GALNT4, Del, C_7, PGCPGLQATGPAAPRPCSRG-PLPGLRPRRAAGRPRRACPPSPRPPRA, (SEQIDNO:5039); XM_014108770.1, VSTM4, Ins, C_7, PGCQRP-PHQHRLCPDPL, (SEQIDNO:5041); XM_005639502.2, ZDHHC23, Del, C_7, PGCRPGAPPR, (SEQIDNO:5042); XM_005634649.1, CHST2, Del, C_7, PGCSRPRLQPRRA-PCSRRGPGARAVAGPRPRSE, (SEQIDNO:5043); XM_845262.3, ITGA10, Ins, C_7, PGCSVWLCHGCHS, (SEQIDNO:5044); XM_014119834.1, EPHB6, Del, C_7, PGCTATGKASGW, (SEQIDNO:5045); XM_005639039.2, C31H21orf58, Del, C_7, PGDQGGSRRTWWR, (SEQIDNO:5046); XM_545710.3, USH2A, Ins, C_7, PGDSRCFCESPQTAHLLDPARAA, (SEQIDNO:5048); XM_005633456.1, GDPD4, Ins, C_7, PGECETTSAKGK, (SEQIDNO:5049); XM_003640232.3, RAI2, Ins, C_7, PGEGGTEALLSPPAEGVLPAEPPHGHQDGQ, (SEQIDNO:5050); XM_005637802.2, TACC2, Ins, C_7, PGEGSFYLGPR, (SEQIDNO:5051); XM_005628050.2, NRBP2, Ins, C_7, PGEPGEHARG-PEHLPGHGHRGGGGGVERVALRRQEGLRSP, (SEQIDNO:5052); XM_541488.5, PNKP, Del, C_7, PGEPPPSSCPRTGKPLSWAGDP, (SEQIDNO:5053); XM_005620748.2, ATXNL1, Ins, C_7, PGFIPSPLIQQSS-CHFPTWAVATSLKYSATGPCSRPDAHL-LSDVQATCWVHFA, (SEQIDNO:5054); XM_542953.5, PLAGL2, Del, C-7, PGFKMQSRRRKWAGN, (SEQIDNO:5055); XM_005635353.2, LOC102153863, Ins, C_7, PGFPASGPPRRGRGRPLSAGEGRDRGGGARAG-GAARGLRGPGPVAACGAARRSCPA GAAFSESP PEA-AGGRKGSVPCTLPP, (SEQIDNO:5056); XM_014117011.1, PKN3, Del, C_7, PGFRT-SAAWPCWAGDTLGRSSWCNSRARGNTTL-SKRSRSRRC, (SEQIDNO:5057); XM_014116431.1, IL11, Ins, C_7, PGFSLGRHPGSPCHSWGAAPDP, (SEQIDNO:5058); XM_543674.5, SMARCD1, Del, C_7, PGGAGRSGSGSFAACGAAPGCRRPGRAS1L, (SEQIDNO:5059); XM_005622774.1, ZBTB7B, Ins, C_7, PGGAPDLRGL, (SEQIDNO:5060); XM_014115768.1, SYNJ2, Ins, C_7, PGGATSRTPGPPEEEEEIGTRSLPPA-GAAEQQPAPPGPHLQHPKQRLAPCTPARPGCT CAATCQPQCFLCHKPRN, (SEQIDNO:5061); XM_014113186.1, NCAM1, Ins, C_7, PGGCAQPER-PRRRGGGLQGPSSQQAGPRRRGPPR-PAGGGPRHRRPGPRARPARRRREE PGRGSRGPH, (SEQIDNO:5062); XM_847992.3, NCOR2, Ins, C_7, PGGCSSPCSATTTALAARERHPPAAQQQPSRQKQEP-CASCRQGGEACVLPGLCTRGP EAAHGGP MLDVR-PALPCAPS, (SEQIDNO:5063); XM_014107094.1, HSPG2, Ins, C_7, PGGDPSPGVHPGFPGSDSDLHLCGH-WRPHPHHQLEA, (SEQIDNO:5064); XM_005620578.2, ZC3H18, Del, C_7, PGGGPSVAAAAAAATAALAPDPGP, (SEQIDNO:5066); XM_014111170.1, PLEKHM2, Ins, C_7, PGGGRGAQQHSREQRALGARPGGPAYPRDE-GHVHGALGAAPEQGDRPAQRAAGPQ HLALPRP PRPVLSGRLSRGRPGEATMLRL, (SEQIDNO:5067); XM_548447.5, SH2D3C, Ins, C_7, PGGHPSSGTQPFC-NEPHRKA, (SEQIDNO:5070); XM_539847.5, TCAF2, Ins, C_7, PGGLLHQCLQ, (SEQIDNO:5071); XM_014118793.1, JRK, Ins, C_7, PGGLPSALLVHGR-RAL, (SEQIDNO:5072); XM_536660.4, MYO15A, Del, C_7, PGGLQSQSQSQSQSQAWMP-PHWLCSKPSSTNRLSYWPGR, (SEQIDNO:5073); XM_534280.5, PIK3CB, Ins, C_7, PGGLRAS-RFQLSRSVRARICCGLPATDE, (SEQIDNO:5074); XM_544915.6, PWP2, Ins, C_7, PGGPAAESPHGLEGR-PAAGGGGGEGGRRGGGGGDHRPGQSHAGCR-GAAGESQILS AGQVLFQQR-GRFQQADRCGLPQEDPSLGHRLCFRNLPPSRAA, (SEQIDNO:5075); XM_548143.3, PNMT, Ins, C_7, PGG-PEQPRRRRALEAALLGADLRYR, (SEQIDNO:5076); XM_536262.5, TBC1D1, Ins, C_7, PGGPPGARGR-PLLGR, (SEQIDNO:5077); XM_014122618.1, DCHS1, Del, C_7, PGGPRPCWM, (SEQIDNO:5078); XM_005622065.1, LOC102151745, Ins, C_7, PGGPVP-GAVPGSWPRAQLTPRGLWLSCHPRYPLQLPGIA, (SEQIDNO:5079); XM_014110313.1, TRIO, Ins, C_7, PGGQ-PLAEQPGLAAPGKAQAWGHLASELSRGRRITSSNR-QGALSPQQPPAEGGLLLE LHPRL-PRQPARLLHLPGGQ, (SEQIDNO:5080); XM_005635990.1, GAL3ST2, Del, C_7, PGGRLHPLRP, (SEQIDNO:5081); XM_014118179.1, PRDM1, Del, C_7, PGGRTATAPTFHPSPPRGTPTTSEKTGAPRCPSTPGPC-TRVGSLCPRTF, (SEQIDNO:5084); XM_541549.5, FOXA3, Del, C_7, PGGSLPLHCPQD-PWRPQPQRHPWGPPSRAWVPAVVGAAARGMGAR-ERGWCRGRR CPKATGGH-WPTPSRHIPTSRSSPWPSSRRRARC, (SEQIDNO:5085); XM_014114365.1, SETD1A, Ins, C_7, PGGSLWPTLCFVHTRARRPGGILPGSLPPAFACSS, (SEQIDNO:5086); NM_001136500.1, SLC6A3, Del, C_7, PGGSSPPAWCWSSSCSTLACGRE, (SEQIDNO:5087); NM_001287078.1, NCLN, Ins, C_7, PGHAGLHGADAD-PAGAAGLSDGLAHQPAAGR-PAGGQGRHAAQHAGALPEPLPEG GEAAPHQGRQTGPRVCLL, (SEQIDNO:5088); NM_001287079.1, NCLN, Ins, C_7, PGHAGLHGADDPA-GAAAGLSDGLAHQPAAGRPAGGQGRHAAQHAGAL-PEPLPEGGE AAPHQGRQTGPRVCLL, (SEQIDNO:5089); XM_014117262.1, TUBGCP6, Del, C_7, PGHCGGRGTTSCTASTSAGTCPTAATTAQT, (SEQIDNO:5090); XM_014110892.1, SH2D5, Del, C_7, PGHCGPWAMPSPRQSCRAWA, (SEQIDNO:5091); XM_005616509.2, DMRTC2, Ins, C-7, PGHGAY-PQESCQPLSNLCPLPKPR-SHCPPQGPQAPVPLSGLRVSQMCPHLGAPKGHG CPGGLASATGGTAQETSGSGPDKEKDSSSQSS, (SEQIDNO:5092); XM_538465.5, ANKRD23, Del, C_7, PGHLSPWLSHSPRPSGSLWTWRCS, (SEQIDNO:5095); XM_539692.5, E2F7, Ins, C_7, PGHSVHGPA VSHAGPVSRALLSHRAQAGLLCRRRAPRCGACAFR-GAQPGIHGSPPHRPHKRG, (SEQIDNO:5096); XM_014108204.1, CABIN1, Del, C_7, PGHTGRRPPPA WSLWAQREKSWQEGRRAWASRPRSPCTVSR, (SEQIDNO:5097); XM_005616594.2, PLEKHG2, Ins, C_7, PGICGPSRGPGNS, (SEQIDNO:5099); XM_014117665.1, TNC, Ins, C_7, PGICHRLPIGV, (SEQIDNO:5100); XM_546587.5, NEURL4, Ins, C_7, PGI-RAALRLVQVQSQGESPPGSWNDD, (SEQIDNO:5101); XM_003434935.3, LOC100687115, Del, C_7, PGIREDGPGCGEYPTEVC, (SEQIDNO:5102); XM_014118914.1, LOC106559676, Del, C_7, PGLAQGRPPLPREAAPAPLATLG-PEPKTPGYLHPHGRGCRLPGQQPR, (SEQIDNO:5104); XM_005629431.1, LOC102155312, Del, C_7, PGLAR-RAGRRGEQQGSSSSNWRRPAPELTPPIRPHLLQA-FAPRDVWGAGTWGRGRA PSCGPANHTGLGP-GASSRRDWGIRGYFAA, (SEQIDNO:5105); XM_005641552.2, PCDH19, Ins, C_7, PGLCDCAGAGV, (SEQIDNO:5106); XM_862738.4, RBM42, Ins, C_7, PGLHGCSETSPGRASNTSRAGAGPGVGPER-EGRGSGGCSSRAGRG, (SEQIDNO:5107); XM_014116191.1, UNK, Ins, C_7, PGLHQEAPKPGRHCLPWGVWPRPWQL, (SEQIDNO: 5108); XM_846897.3, TBC1D10C, Del, C_7, PGLIEAPHPSWIPDS, (SEQIDNO:5109); XM_541958.3, USHBP1, Del, C_7, PGLKPLTCFRFSSML, (SEQIDNO: 5110); XM_014109098.1, COL17A1, Del, C_7, PGLLEPWDRQDLQVPQVLWAQLVSLDSKA-HAASEDLLANRSWAAAAPSLSSSLPK VLTYGVPQAHLDHQGLQEKAGRARRALRDLC, (SEQIDNO:5111); XM_014109099.1, COL17A1, Del, C_7, PGLLEPWDRQDLQVPQVLWAQLVSLDSKA-HAASEDLLANRSWAAAAPSLSSSLPVL TYGVPQAHLDHQGLQEKAGRARRALRDLC, (SEQIDNO:5112); XM_014110341.1, AIMIL, Ins, C_7, PGLLFSSGDDEETCSRCQGPPPRAGARVASKQ, (SEQIDNO: 5113); XM_541508.4, PLEKHA4, Ins, C_7, PGLNFSPKPGDRYSVDQAVWAGPAPEE-AAGGDRPEAGGKGAARSSLGVN, (SEQIDNO:5114); XM_014108770.1, VSTM4, Del, C_7, PGLPKASP-PAPSMPRSSLRRTRC, (SEQIDNO:5115); XM_541408.4, ZNF579, Ins, C_7, PGLPQRLLFRQPRPFSL, (SEQIDNO: 5116); XM_539044.5, BACH2, Del, C_7, PGLPVAPPPPPPPPPPRRIARGGRRAATRGASRRG-GLRWNPGARR, (SEQIDNO:5117); XM_538386.5, SH3BP1, Ins, C_7, PGLQHALLPSSPPHIPWL, (SEQIDNO:5118); XM_003638871.2, PTCH1, Ins, C_7, PGL-RAPSSWATRPAAPEGTPQRRLAAAPLQTAQRRF, (SEQIDNO:5119); XM_014114192.1, ZNF853, Ins, C_7, PGLRGAAGAHGAACRGRARGGGHSR-PRGQRGSDSGQAAAAAAGAGSADHLRGV WQGLQPQHGPGAPPGHAHGRAAAPLRRVRQGL-LAALQPGDAPAHPHR, (SEQIDNO:5120); XM_005630011.2, WWC2, Del, C_7, PGLRPPSL, (SEQIDNO:5121); XM_014114909.1, VSIG10L, Ins, C_7, PGLWGHCWHRPGFPTGPGPPSIASLQVHPLPVQF, (SEQIDNO:5122); XM_843592.5, CACNA1S, Ins, C_7, PGLWQVLPTPGGLQAAGGHEHALEQRRHRHLQRH-ALRAGPHGPQDQDGR, (SEQIDNO:5123); XM_014110056.1, LOC102151348, Del, C_7, PGMRRLTTSPPTRSS, (SEQIDNO:5124); XM_005619930.2, MINK1, Del, C_7, PGMTTSSGW, (SEQIDNO:5125); XM_014121829.1, TMIGD2, Ins, C_7, PGMWPPPPGHVRPP1, (SEQIDNO:5126); XM_546181.5, ZMIZ1, Del, C_7, PGNSPCSPPSTL, (SEQIDNO:5127); XM_005617936.2, KLHDC7A, Del, C_7, PGNWDPGSRTPPPPTGRPTWKARLT, (SEQIDNO: 5129); XM_542201.5, PCSK4, Del, C_7, PGPAAVWN-LETS, (SEQIDNO:5130); NM_001289435.1, SLC4A3, Ins, C_7, PGPAEPRGRGTSLSPAGGQPWRAAAPSEEAVS-DAGRQGQPRWPGPRPAQEEEEEAA GSEASRGVC-GAE, (SEQIDNO:5131); XM_843844.3, ADAMTS2, Ins, C_7, PGPAPGARS, (SEQIDNO:5132); XM_005639813.1, ST6GAL1, Del, C_7, PGPARPSA VPGAQSRPSPRPPSRCGTRTALPKTSSPGYRRSGEII, (SEQIDNO:5133); XM_005624595.2, ARHGAP23, Del, C_7, PGPAVPPRTG, (SEQIDNO:5134); XM_849794.3, TMEM143, Del, C_7, PGPCRHWRPRWGSTARCGTPR-SPATGPSSTASGSSRSPRSSCSAS, (SEQIDNO:5135); XM_541508.4, PLEKHA4, Ins, C_7, PGPDPGGGGVASASHAAAVQLL, (SEQIDNO:5136); XM_845969.4, C1QL4, Del, C_7, PGPEGL-RESRAGRVPRVLPAQAPAGWRPLPATCLASP-STRVCGGRTRVTRCCASTT W, (SEQIDNO:5137); XM_014119248.1, DLGAP3, Del, C_7, PGPGPSP-PHSSSRPSQAGRSCGAWRASASGGRP, (SEQIDNO: 5140); XM_014112163.1, LOC100856005, Ins, C_7, PGPGQPGAPGGALGEH, (SEQIDNO:5141); XM_014112944.1, LDB3, Del, C_7, PGPKCPPWP-GASCSGRSASRPAAGPRSAATATTSSGAPFW, (SEQIDNO:5142); XM_014119707.1, E2F7, Del, C_7, PGP-PAPRPT, (SEQIDNO:5144); XM_005628933.2, ZC3H12A, Ins, C_7, PGPPGWGHPQGSQP-GALTPGGEQGGQ, (SEQIDNO:5146); XM_014107580.1, NYAP2, Del, C_7, PGPPRPPPPRCPPPRPRRPPCTAR-SPPTATPRATRPRRRP, (SEQIDNO:5148); XM_005624595.2, ARHGAP23, Ins, C_7, PGPQCLPGPVRGSDCPPPMALLHLPGCLEPVGPGR-LAPSSLRRLLEPGHPLS, (SEQIDNO:5149); XM_014106771.1, XIRP1, Ins, C_7, PGPQYGA-GASQRPGGHLPPPTDHGKASASSWGEKARR, (SEQIDNO:5150); XM_543467.4, RHBDD3, Del, C_7, PGPRCGQPWMSKCCRRGSRPHSLRGQPSVL-RAHYGCLSPPSPLCGCSSWSAWASRQ SRQWWHWLPQAEWRVLCHCWLAGRWALRPW, (SEQIDNO:5151); XM_014121783.C PTPN23, Ins, C_7, PGPRPPCCGPGPWSCSLPCPCLHSRVGT-CAPVVPTARCGKQSLWGGRTTPASCRSAL CPSSPVLRTRDGPGGSASHDHCG, (SEQIDNO:5152); XM_543274.5, IRS1, Ins, C_7, PGPRRG-GAEQLHLHGRQRVLHPHRPQRSLHFASGWQWP-PLHPGGWLGHQPGPGCG, (SEQIDNO:5153); XM_003434863.3, VASN, Del, C_7, PGPRTARRPFAST-GAPVTWGCRATWSACALSSSWASTARAG, (SEQIDNO:5154); XM_014110201.1, PHLDB2, Del, C_7, PGPRWAAPGGRGRGTGSRPPAARSTTAT, (SEQIDNO: 5155); XM_846534.4, PRCC, Ins, C_7, PGPSQAKEED-GAREDRGAGAASGGFRFRGR, (SEQIDNO:5156); XM_014115719.1, KIF26A, Ins, C_7, PGPSRAQVQPGTQEQPGSRRAPGRGPDPGRGCRLP-PRGGGGQAGRPG, (SEQIDNO:5157); XM_014106882.1, COL20A1, Del, C_7, PGPSWRRPSSLDEEDRTVPAPRTEASPEPSVPWAAL-GRKGASLQDP, (SEQIDNO:5158); XM_014113507.1, ARRB2, Del, C_7, PGPTHPSPPLACRTGC, (SEQIDNO: 5159); XM_536071.5, RNF25, Del, C_7, PGPVEAPGNSLNGGT, (SEQIDNO:5160); XM_537756.4, CPD, Del, C_7, PGPVVATTAAAVT-STAASPTSSAPASPRPWTRCPRCAPSWTGSAGTSS-CFLEICMVA QW, (SEQIDNO:5161); XM_849794.3, TMEM143, Ins, C_7, PGPVVTGDQDGGVPQDVE-PHGAPRLGPAVPRAVHPVLQGAAAPPPNT-GIPLQPCGE GSFGGFCSPRGLIHLVPLPPHPGPAAGLV, (SEQIDNO:5162); XM_005618689.2, GAK, Ins, C_7, PGQAAPQGLSAAKA, (SEQIDNO:5163); XM_014108452.1, TNS2, Ins, C_7, PGQAVFHLQSHGDVAQC, (SEQIDNO:5164); XM_003431483.3, KIAA1644, Del, C_7, PGQGSPPR-SPSPRQACCHRRPRPCTHCRETPTAHRS, (SEQIDNO: 5165); XM_014110586.1, RREB1, Ins, C_7, PGQQPR-GRHPEPEGEPGRRHQGSQPQGGAGGASDGGRWPG, (SEQIDNO:5167); XM_005631406.2, SSH3, Ins, C_7, PGQRPLHARGAHAGPGIQAEKPAPAKAEL-CSAPWGCPGTAGWRRQWRSS, (SEQIDNO:5169); XM_540820.5, SSH3, Ins, C_7, PGQRPLHAR-GAHGPGIQAEKPAPAKAEL-CSAPWGCPGTAGWRRQWRSS, (SEQIDNO:5170); XM_536071.5, RNF25, Ins, C_7, PGQSRPLETA, (SEQIDNO:5171); XM_014113666.1, RAI1, Ins, C_7, PGQT-GRQAASRLQVWQAGGQAVTQGGVQPQ, (SEQIDNO: 5172); XM_014119248.1, DLGAP3, Ins, C_7, PGRAQAPHTHHQDHPRQGGAAEPGAPAQVAAVHR-GAGGDYLRLGH, (SEQIDNO:5174); XM_014115697.1, LOC102152805, Ins, C_7, PGRARSAVSGALARRLR-MARCGPRPGVYPEQASTSRHSQPHRVL, (SEQIDNO: 5175); XM_544279.5, KLF6, Del, C_7, PGRCAE- GLRGSPVTRAAGTPPRMAGGGCIAATLTAAGKFTP- KAPT, (SEQIDNO:5176); XM_014111403.1, ESX1, Ins, C_7, PGRGGATDRGEKAPPQPHRIHPVAAAGAG- GRFPSHSVP, (SEQIDNO:5178); XM_005619884.2, LOC100688504, Ins, C_7, PGRGLLPRPFPAPLH- LYLRGHRLLDHLLHLHPPAAGL, (SEQIDNO:5179); XM_861784.4, SERTAD1, Ins, C_7, PGRGLQFPLGPF- CAQAPPQPAAE, (SEQIDNO:5180); XM_543059.3, CYP24A1, Del, C_7, PGRGRCPCARPWSRARRR- TRPPCGAPPTGRCWAACWRFSGRGASRNSTTRWP- STTR STARSSA, (SEQIDNO:5182); XM_005619435.1, LOC610073, Del, C_7, PGRGRFSPPLRPRRAEKAAQP- GAGGRGQPGPLSGSGNPMGVR (SEQIDNO:5183); XM_014120942.1, SCYL1, Del, C_7, PGRGSPNLSSMT- PRSWLMA- VAEQLERNGQLTCGAWAASSGKSSMGPYLGRLPCAT LGRSPSRWCPITVN, (SEQIDNO:5184); XM_005640837.2, MIA3, Ins, C_7, PGRLGWHVGRDAATP, (SEQIDNO:5186); XM_014117194.1, B4GALNT1, Del, C_7, PGRN- CRTSRLSPAMHTSPSGSRSKWWGCSLGTTAVVSPAE- GAFTSPSRGRSEPLTSPR PLT- PRSCWLPLPPGSRSSRPSFQGASPPLTSCS, (SEQIDNO: 5188); XM_U14116817.1, MYO18A, Del, C_7, PGRPARGPGMSWMNAAPPSPRPPAAALAGGWRRG- GAQTLTGPPPSLPPPAGPLRPP GVAPGALVRTGPAPP, (SEQIDNO:5189); XM_536920.5, LOC479792, Del, C_7, PGRPCAGGC, (SEQIDNO:5190); XM_014110547.1, GABBR1, Ins, C_7, PGRPDPGHQDIS- LHVTEALHFSLCPLQPGHCPGCGLSVL, (SEQIDNO: 5191); XM_014108804.1, SORBS1, Ins, C_7, PGRPEARPPQPAPSGRDPLWGEAL- GSQTPVFPTHHGEAEPDLGAPSGETRSPRGLPEG LS, (SEQIDNO:5192); XM_014117212.1, TBC1D30, Ins, C_7, PGRPPESAPL, (SEQIDNO:5193); XM_005616836.2, LOC102154596, Ins, C_7, PGRPRSPPLRQPELRPQ, (SEQIDNO:5195); XM_014110527.1, LOC106558240, Ins, C_7, PGRRDDARRELQLAWARH, (SEQIDNO:5196); XM_849440.4, CYP2R1, Del, C_7, PGRRGCHLSAT- STRWRPRASSPTST, (SEQIDNO:5198); XM_005624045.1, DNAH17, Ins, C_7, PGRRGQCHGR- RHDPDRPRGQDPQGQELESRENHDGQSGHLPGL- PEKVRQGAHPRG LPKSV, (SEQIDNO:5199); XM_014108311.1, LOC106557876, Del, C_7, PGRRPPR- GRARAPTPAGSGAPTRAGNPPSPPA- PRFVSGGVALRRSRSHKSP, (SEQIDNO:5200); XM_003640189.3, FZD5, Ins, C_7, PGRRRRLPQAGVP- VARV, (SEQIDNO:5201); XM_014122241.1, AMH, Del, C_7, PGRSAARGRGRPTGPARCAS, (SEQIDNO:5202); XM_538929.4, PTK7, Ins, C_7, PGSARAQCMVGACR- SPATHPWQSLPRGP, (SEQIDNO:5203); XM_005625532.2, STAT6, Ins, C_7, PGSED- SDQVPGWGSILTGPAVGGPRQASAGQGRHGD, (SEQIDNO:5204); XM_014121804.1, CACNA1A, Ins, C_7, PGSGEEVSGQSGLQEAPSHGSACGRRQHR- PLQFYPHGSDPHSPGHQDRQGRSRQTA DGR (SEQIDNO:5205); XM_014109870.1, COL6A2, Del, C_7, PGSGRRPCSAPLASRFSATR, (SEQIDNO:5206); XM_014112130.1, LOC608320, Del, C_7, PGSLIASLDPSLGTKLPSPSQEPSLRMRLLLFT, (SEQIDNO:5207); XM_005616269.2, POLDI, Ins, C_7, PGSPEGAPHLPAVGDRSLCGPSTAPARSTHAIPRL- RAYPASLWSHR (SEQIDNO:5208); XM_005629431.1, LOC102155312, Ins, C_7, PGSPGGLGAAGSSR- GAAVPTGGGLRRS, (SEQIDNO:5209); XM_005637414.1, ANKRD33, Ins, C_7, PGSPWLPGPHPLPEPSGHVECVPSVATTQRQ, (SEQIDNO:5210); XM_546506.4, DSCAM11, Ins, C_7, PGSRPGPCRAPCRPQCCPSGPQHRASEGRGPTHQN- GRFQGLASRDEHIGGGEVSEAG GGGLLQILYPGV, (SEQIDNO:5211); NM_001130437.2, PABPN1, Ins, C_7, PGSSGPWAWLGSPRQPGGGGGAGTGRG, (SEQIDNO: 5212); XM_005622571.1, POGK, Del, C_7, PGSSPVGWKSAATGTGG, (SEQIDNO:5215); XM_005621146.2, SDK1, Del, C_7, PGSSWCPRQK, (SEQIDNO:5216); XM_850107.5, R3HDM4, Ins, C_7, PGSTRHLRRGLQQ, (SEQIDNO:5217); XM_014117262.1, TUBGCP6, Ins, C_7, PGTAAAAGLL- PAQPARRQERALRRLRLLRPER- VRDGCALVDLRGGVLVPGRGPRGA AGDGGGPGRR- PARRGVGALLLRRPLRGQV, (SEQIDNO:5218); XM_005635288.2, CHRNA4, Del, C_7, PGTCPCLRP, (SEQIDNO:5219); XM_014110191.1, PIGZ, Del, C_7, PGTFSTSQAWARPWRWWTWVGPRTGSCAVP, (SEQIDNO:5220); XM_005630260.2, EIF2B4, Ins, C_7, PGTGGSGDHGAGDDSLQFCTGCSTSQE, (SEQIDNO:5221); XM_005621660.2, KREMEN2, Del, C_7, PGTLRLRV, (SEQIDNO:5222); XM_014113787.1, SAMDL1, Ins, C_7, PGTPRPRPPDPSP- GACPPSPSEGGPQPCLSPLQ, (SEQIDNO:5223); XM_005619884.2, LOC100688504, Del, C_7, PGTRAAT- STISRTSPSLSTRPSPSRSPPASSPTSTCSWP, (SEQIDNO:5224); XM_014109643.1, C30H15orf39, Ins, C_7, PGTRALCPGAPGSSAE, (SEQIDNO:5225); XM_005640267.2, XIRP2, Del, C_7, PGTSCPVSLRLT- GRPSPPRQVQPAPRPRPRPRPHPRTRPRPRSPRVARSS- WPSSETPPP G, (SEQIDNO:5226); XM_014107696.1, NEU4, Del, C_7, PGTSPWSAASLP, (SEQIDNO:5227); XM_014114472.1, ZSCAN10, Ins, C_7, PGVPGVRQELQPQL, (SEQIDNO:5229); XM_005631208.2, TNKS1BP1, Del, C_7, PGVPWLSCLLPGR, (SEQIDNO:5230); XM_005630877.1, LOC102151356, Del, C_7, PGWAGRLSFRKAHSQARL- GASGDQQALRGSSGTPSPSPPPCQEY, (SEQIDNO:5232); XM_005637634.2, SFXN3, Ins, C_7, PGWQICAL- CSGGSCQLHQHPPDEAEGTAGGHPSD, (SEQIDNO:5234); XM_005638643.2, LOC102157171, Del, C_7, PGWSHLTRASSWASPAPRAPWDLLARASGLSAL- CGEPSRSPGSVLLCPAPAPPRALT VLQAVWPPPCSHALLLPRALTAFLCLLPSRAPGPCL, (SEQIDNO:5235); XM_847680.4, CHERP, Ins, C_7, PHAATGPSPHQP, (SEQIDNO:5236); NM_001003291.1, ICAM1, Del, C_7, PHALLPPRLWK- WAHSGLWTALWMGCSQLRRPKSTWR, (SEQIDNO:5237); XM_014121720.1, ARHGAP21, Ins, C_7, PHAP- LARPCPRKRSSPEAGGAASDRARASSAASL, (SEQIDNO:5238); XM_014113960.1, FOXL1, Del, C_7, PHAPLPTALPRAPTSPRASA, (SEQIDNO:5239); NM_001007126.2, DIO1, Del, C_7, PHAPWWWTR, (SEQIDNO:5240); XM_845621.5, MLLT6, Del, C_7, PHC- CLPGPW, (SEQIDNO:5241); XM_844150.4, FAM155B, Del, C_7, PHCGPLTPLPVPRPSSPPPKKTCSKATFGTSL- SPFATPTRSGTCCWAWTAPTAWTAA WTPCWGTCWL, (SEQIDNO:5242); XM_014107051.1, ZNF335, Del, C_7, PHCSVLTPLVGPPSSTSKVLRSRQQWPRRRPWICC, (SEQIDNO:5243); XM_532087.5, NELFE, Del, C_7, PHEAAAGTIVVSGTGTETVIENGIET- VIGTGTAIGTGTAIGTGTVIGTGTAIENERALSA GRIHSLNAGPLGRVILSMCMERT, (SEQIDNO:5244); XM_014114351.1, STX1B, Del, C_7, PHEPPEAPSRAP- STPRPRPSGMIGACARGRVSSSPEGA, (SEQIDNO:5245); XM_005616531.1, CIC, Ins, C_7, PHFGGGGTWKGSPSRH, (SEQIDNO:5246);

XM_537251.5, ASH1L, Del, C_7, PHFLLLPICMLAIYF-SIQPNTIRKSISYFARRPF, (SEQIDNO:5247); XM_005616826.1, LOC102153346, Del, C_7, PHFLPSLLHPSPQGQGLPGPQT, (SEQIDNO:5248); XM_014113005.1, FAF2, Del, C_7, PHFRRPD-SATQKFSLFRT, (SEQIDNO:5249); XM_014112760.1, LOC106558669, Del, C_7, PHGLPEEP, (SEQIDNO:5250); XM_014107872.1, VPS37B, Ins, C_7, PHGPAPPA-RILCTVHVSIPTRSSPETPAPAASTPARLHPPV, (SEQIDNO:5251); XM_014116373.1, LOC490917, Del, C_7, PHGRRTGTRAAGAPTTTTQTRA, (SEQIDNO:5252); XM_014116484.1, HOXB4, Del, C_7, PHGS-REPWGGGGL, (SEQIDNO:5253); XM_005622745.2, TRIM46, Del, C_7, PHHFLPPPCLCLPPLCQLRP, (SEQIDNO:5254); XM_005626204.2, SBF1, Ins, C_7, PHHQGQGAFPPDPVPESREERQENHWPAVRD-PEKVQPPQLGAPGPAPSRGPGG, (SEQIDNO:5255); XM_005631742.2, SHANK2, Del, C_7, PHHRQAVPSLPPR, (SEQIDNO:5256); XM_846492.4, XIRP1, Del, C_7, PHHRRVPIPQERGPQLVPSKGPLR-TRRFCREASKSSRAC, (SEQIDNO:5257); XM_014110880.1, MYO3B, Ins, C_7, PHICISRC-CLPMYGYFQQRPVHCHQWRKWLWEDRECPPDCSAFD-FLGKGQ, (SEQIDNO:5258); XM_005641785.2, PRR32, Del, C_7, PHISPQLDQG, (SEQIDNO:5259); XM_849543.1, GPR152, Del, C_7, PHKWTLQPSPSWILWLPHGQILGSSLS, (SEQIDNO:5260); NM_001110767.1, MYH9, Ins, C_7, PHLCH-HRHRLQEYDARPRGPVHFVHG, (SEQIDNO:5261); XM_543989.5, PSD, Del, C_7, PHLHLGWAQGRAL-GWLWGEQPSTPRRTWTRCP, (SEQIDNO:5263); XM_014116032.1, RGS6, Del, C_7, PHLIFCPGVLRRKYPTALGAARLVHLLQQLREKAIE-LYH, (SEQIDNO:5264); XM_014118200.1, WASF1, Del, C_7, PHLLHHLFHLPCQLLH, (SEQIDNO:5265); XM_003639958.3, ATN1, Del, C_7, PHLLPIAGS, (SEQIDNO:5266); XM_014118924.1, TEAD2, Del, C_7, PHLLTSQGTSLPKPCHPLPCPHLPHHPQPGRLGP-WALPGCSWWSSQPLWNRPMQLIL RTSTGARVARR, (SEQIDNO:5267); XM_014115267.1, ENAH, Del, C_7, PHLPLRLPLPPSLHLDFLRHPRPKTIAL, (SEQIDNO:5268); XM_005617572.2, NKD1, Ins, C_7, PHLQPHSVSLP, (SEQIDNO:5269); XM_005636883.1, KMT2D, Del, C_7, PHLRYPACPPCLR-CHACPHHLRNLPCPHHPKSPPHPLHLRLPACSHHLRT-PRLPRRLK THLLLRHRRTYS, (SEQIDNO:5270); XM_546371.5, CDH12, Del, C_7, PHMIHWQHMRMKEMDQ, (SEQIDNO:5271); XM_014117984.1, LOC102154618, Del, C_7, PHMLLQGHSNSPQTAGSAMPV, (SEQIDNO:5272); XM_005624339.1, RARA, Del, C_7, PHPAAVALA-SAPAQTEAARPPTPR, (SEQIDNO:5273); XM_540770.5, PIDD1, Ins, C_7, PHPALPGGGCQDPEW, (SEQIDNO:5274); XM_014119811.1, LOC106559806, Del, C_7, PHPAMLPISTKWIWRRCL, (SEQIDNO:5275); XM_005639705.2, IRX1, Del, C_7, PHPAPRRTPVS, (SEQIDNO:5276); XM_003638834.3, RYR1, Del, C_7, PHPAQLSPPTTSTPCWVTSCESSSTTWALTRPHG, (SEQIDNO:5277); XM_014106880.1, RBBP8NL, Del, C_7, PHPDCSPPRALGRPSRRRRWEATRRPRTTMQKSL-RATGHLQWPKSPRVPTCLRHGP QT, (SEQIDNO:5278); XM_005628972.2, GJA4, Del, C_7, PHP-GAPPQSPMPTRSSSTCPWERDPRPRRAPPTTGSPPAS-RTGPT, (SEQIDNO:5279); XM_005625442.1, PRDM12, Del, C_7, PHPGLQPKSLFWATHGQ, (SEQIDNO:5280); XM_014106943.1, RIN2, Del, C_7, PHPGPRHPL-LIVCTQALSCPGLKPRRACQKQSTITNMGT, (SEQIDNO:5281); XM_849945.3, PGLYRP1, Del, C_7, PHPGPSGRPRVCWLVVWLREN, (SEQIDNO:5282); XM_014111262.1, KIRRE1, Ins, C_7, PHPHLDQKGFKHGAQASWLPTRGCSLCPGPE, (SEQIDNO:5283); XM_005640916.2, KIRRE1, Ins, C_7, PHPHLDQKGFKHGPE, (SEQIDNO:5284); XM_005634969.2, FAM83C, Del, C_7, PHPHP-PASASAASNAH1, (SEQIDNO:5286); XM_014117368.1, TRIOBP, Ins, C_7, PHPHPRVHWAP, (SEQIDNO:5287); XM_848813.4, ACD, Ins, C_7, PHPLGLHPL, (SEQIDNO:5288); XM_005626251.1, ANTXR1, Del, C_7, PHPLHPI-ALPHPPVLPPLRFHPHRPPFPLPLTPHL-PAGRHPPPDLLPGLLS, (SEQIDNO:5289); XM_014118742.1, SCRIB, Del, C_7, PHPLSQPPAPWSL-PALESLGRSGWLLACWLPPWRGRTRWRRSASQEP-GAHWGSASS GALTT-PATRLVSRSLACSSPRCSHGAWPHVVAFELGTAFWQ, (SEQIDNO:5290); XM_541879.3, SEMA3F, Del, C_7, PHPLTRSWPSCWPSQKWASSTSTARAI-GATCPQAPGRHQGRPGLLNPRTRKSPGTAA TTRRTH, (SEQIDNO:5291); XM_541589.4, CIC, Del, C_7, PHP-PAPPQLPQAG, (SEQIDNO:5292); XM_005627115.2, DDR1, Del, C_7, PHPPGPNPPTPR-PAVGTIWSLRSRVPHFCPHLPRTASPINIPRLTL-SPCRASQGATPNIL CPRCPQGLPGMGLPEWISLD-LGSASRRSLARASLGRCTCVR, (SEQIDNO:5293); XM_014114445.1, LOC102155512, Del, C_7, PHPPGWR-GLSGAVSPLRSLGLHARASPHPPWRLRPY, (SEQIDNO:5294); XM_014112562.1, FAM193A, Del, C_7, PHPPPPMAPSALHPAFAATPTVRGTAVRT-ACMTHSRTMGMRVPTRTAALSIALAPQP PPTRR-RASTVTAATVSSSGMVGLQLHQQVEIMQR, (SEQIDNO:5295); XM_545354.5, ATXN1, Del, C_7, PHPPSRTSTCTSPALRRAPGARPLLRPSPSTSTRTRR, (SEQIDNO:5296); XM_014113237.1, LOC106558756, Del, C_7, PHPPTRAGRRPLGLCPLHPGSS-PADPSPLAVPMPNPRLCYCPALRTNGAQARGNPQT RGVGKPSRAGAGRRGPGVGGAGFLPSHL, (SEQIDNO:5297); XM_545695.2, AVPR1B, Ins, C_7, PHPQPQPQWGPRA, (SEQIDNO:5298); XM_005626284.2, FLT4, Ins, C_7, PHPREGGFLPQHLLPPQSPGPHLHCLRGAPPSQCPVA-LAAMDTLQDLHQAQPQPAA AER-PHATVPGLARGDHPGCREPHREPGHLDRVCGGEE, (SEQIDNO:5300); XM_003433968.3, RIPPLY3, Del, C_7, PHPRGRGRRCQAPYLGALPGRPSLPRAPRAPVARA-RGPAARPHLPPGGGVPAKDTA GGSGGIGNRLWQR-PAPHRGDLGS, (SEQIDNO:5301); XM_014121062.1, PHF21A, Del, C_7, PHPVILTPPKMKRQRPHSLSLHLF-SLCPCPAPPPQTVISMRIFAAFAGKVASCLCVTHV PVCIIWTA, (SEQIDNO:5303); XM_014122225.1, TYK2, Del, C_7, PHPVRTLGWSSEWYSRC, (SEQIDNO:5304); XM_005627166.1, EHMT2, Del, C_7, PHPWLRM-PLGEQTLPSPVPGCEGMGSPGAHPATLWPTP-STAQGPP, (SEQIDNO:5305); XM_005630632.1, HIPK1, Del, C_7, PHQCRRVPSAVRRN, (SEQIDNO:5307); XM_843722.4, MAP3K12, Del, C_7, PHQDGVV-VARLGTGRPAPRAAAETCLG-FARLCHPMNPGDQEARGG, (SEQIDNO:5308); XM_005621172.2, MICALL2, Ins, C_7, PHQGQLGPNVSRPSRHPRLGPISSLQDAAGP-GEVLPDSWSCPQPWPSWQGPGSCRCA F, (SEQIDNO:5309); XM_014118653.1, LOC106559635, Del, C_7, PHQMTLMCWLGAPFCSTHPHERTGRPRVLLPP-SALLA, (SEQIDNO:5310); XM_014116993.1, NUP214, Del, C-7, PHQQQLPPPFLPHSPHCPLVAS, (SEQIDNO:5312); XM_005616859.2, BCL2L12, Ins, C_7, PHREGSP-

TAEAGCLAGGRG, (SEQIDNO:5313); XM_545880.5, IL16, Ins, C_7, PHRGAAAARARA TAAGHPHLLQDQRAGSVGVPSPRTAVQSGDPPPRP, (SEQIDNO:5314); XM_014122125.1, KDM4B, Del, C_7, PHRHLSTSCPPRHLARSQR (SEQIDNO:5315); XM_005633018.1, KDM4B, Del, C_7, PHRHLSTSCPPRHLARSQRPLSTLPRGAPPGRNRRPPWS, (SEQIDNO:5316); XM_005633017.1, KDM4B, Del, C_7, PHRHLSTSCPPRHLARSQSRPLSTLPRGAPPGRNRRPPWS, (SEQIDNO:5317); XM_014111179.1, SOX13, Del, C_7, PHRLASCK, (SEQIDNO:5318); XM_845641.5, EPN1, Del, C_7, PHRPHGRHQSHSWGLMQPSLTWTRW, (SEQIDNO:5319); XM_542234.5, MAML2, Del, C_7, PHRPLLPPRRPPKQPPPQPHRPRQTITITTSSTCSAVAIMVAVVGSTGSSRHKLQPLGT RGTQP, (SEQIDNO:5320); XM_850565.3, MGAT1, Del, C_7, PHRRGMAMILAGI, (SEQIDNO:5321); XM_005626805.1, CCIN, Del, C_7, PHRRHWTVLPAV, (SEQIDNO:5322); XM_014107845.1, EP400, Del, C_7, PHRRPRQGPHSPLHKCKCRPRHPRRSRAPSWPRSRPRGPEPCSRAPPWPTSRWPGSCRRKGRCRLRRPSPLRWRLRSLQWCPCLRPWSPRQV, (SEQIDNO:5323); XM_014107852.1, EP400, Del, C_7, PHRRPRQGPHSPLHKCKCRPRHPRRSRAPSWPRSRPRGPEPCSRAPPWPTSRWPGSP GFPLRSCRRKGRCRLRRPSPLRWRLRSLQWCPCLRPWSPRQV, (SEQIDNO:5324); XM_014108566.1, HDAC7, Del, C_7, PHRWAPCSPAWTGSNRTSS, (SEQIDNO:5325); XM_014111758.1, RASGRF2, Del, C_7, PHRWLCPGRPPQ, (SEQIDNO:5326); XM_005619461.2, LOC102153808, Del, C_7, PHSALRTGQPPGEHSTARPRPLPRTAPCGSPFLALSTGC, (SEQIDNO:5327); XM_005621171.2, INTS1, Ins, C_7, PHSGPSEKSKPVPASRAPAVPEPKPRLSPQHHPEAGLLAVHALAGRPGAVQRGFAGR AACAVPV, (SEQIDNO:5330); XM_014121645.1, EFCAB12, Del, C_7, PHSQSPASKPWELGTSKGSQRMRRPGSAKG, (SEQIDNO:5332); XM_532215.5, DOPEY1, Ins, C_7, PHSRQSEIHS, (SEQIDNO:5333); XM_005623133.1, CTIF, Del, C_7, PHSRTAAKTTLWTCWARISGLPTPLIPSVVPPGTCSPKSWTSPSSTGS, (SEQIDNO:5335); XM_005633132.2, DAZAP1, Del, C_7, PHSSALATGLHHHHRISLPPQGSLLHLLLQGQHLWPSLRLRLRPPQT, (SEQIDNO:5336); XM_536901.5, BCL7C, Del, C_7, PHSSASAQMPPTP, (SEQIDNO:5337); XM_847197.3, SCAND1, Del, C_7, PHTLAAPDPARRHSASVSGSSATRTPQVRGRRSGSCGSSPASGCDPTSARRSRSWRC WCRSSCWPSCLRRRGPGGFAAAPMCASRA, (SEQIDNO:5338); XM_005636020.2, TRPV4, Del, C_7, PHTLTAPPWTT, (SEQIDNO:5339); XM_005640917.2, SUSD4, Del, C_7, PHTPAQGTRTRARGRPNPVTAARALPSCSRVRTRLPGATGAHAPAAWTRVLARWE RRRPLARASTSQT, (SEQIDNO:5340); XM_846233.4, PPFIA1, Del, C_7, PHTPHLCSRAPPLRTVGAPPHEGARTAQPGRWTDWGS, (SEQIDNO:5341); XM_534998.5, PPRC1, Del, C_7, PHTRGGEDPVAVPLDVPEDALPLLPPHLLPLLPHLRHPVLEAGPAPHPPDGEVTGGG GTVLIVHMTITKGRGCCRRSVQ, (SEQIDNO:5342); XM_014110312.1, AHRR, Del, C_7, PHTVPAWSTCMALLSRMAPATSVRRLSSPLHCPVTAKPQSPRPSSNESPWTHRHGPV TARVGCLECSPKVPWQH, (SEQIDNO:5343); XM_014122638.1, ARAP1, Ins, C_7, PHWDATPAGEPSLQGREASVTTTVITSPARA, (SEQIDNO:5344); XM_531794.5, TMEM 131, Del, C_7, PHWKVNSAEISLPRFLFQLH, (SEQIDNO:5345); XM_014117000.1, HMCN2, Ins, C_7, PHWLDCQRPASHGGCV, (SEQIDNO:5346); XM_540490.4, SIRT7, Del, C_7, PIAGGRTPSSPWPLPCVRVKKVATVGSRCAEAERTLRLGTGVRP, (SEQIDNO:5348); XM_014119957.1, MGAM, Del, C_7, PICHIWSPGIKA, (SEQIDNO:5349); XM_014116315.1, LOC102152536, Ins, C_7, PIIKARARGACLCP, (SEQIDNO:5351); XM_538150.5, IL13RA1, Del, C_7, PILSVSSSKMVTCMCNGRIHRIFIADAYLTK, (SEQIDNO:5353); XM_014115723.1, ADSSL1, Del, C_7, PILTYLHVGHIPARPWGCWPQRS, (SEQIDNO:5354); XM_014110586.1, RREB1, Ins, C_7, PIPAEAQAAVLQEETQS, (SEQIDNO:5355); XM_014116790.1, FAM222B, Del, C_7, PIPCCMEVGRCQTQMPPRM, (SEQIDNO:5356); XM_005636020.2, TRPV4, Ins, C_7, PIPLPHHRGLPEAGWRDHHALHRGPVLLYQYQRLVHEEMPRSEFSLH, (SEQIDNO:5357); XM_543571.4, LOC486445, Del, C_7, PIPPATPTGPQSPSVDSNPWMLTA, (SEQIDNO:5358); XM_014119811.1, LOC106559806, Ins, C_7, PIPPCSPSPPSGSGGGVL, (SEQIDNO:5359); XM_854308.3, PCOLCE, Del, C_7, PIRSASGQ, (SEQIDNO:5361); XM_014116993.1, NUP214, Ins, C_7, PISNNCHPPSYRIPHIVLW, (SEQIDNO:5362); XM_543989.5, PSD, Ins, C_7, PISTWGGLRAGLWGGCGASSQVLRDGPGHGAPEVLPRDRHR, (SEQIDNO:5363); XM_005630632.1, HIPK1, Ins, C_7, PISVVECLLQCEETENRALWLGCFWTEQQRQILYPQQNPPSHTRASQLLSPGSKFQHP CLRPGPPP PSSCSGAYCCNSC, (SEQIDNO:5364); XM_005624926.2, INPPSK, Del, C_7, PIWPTMTRGWSTLTGSWRCRILKNRISLTSWTMTSFSGLET, (SEQIDNO:5366); XM_014108376.1, CECR2, Del, C_7, PNLALFHR, (SEQIDNO:5367); XM_005624978.1, LRRC3C, Del, C_7, PKAATWQKKLVSGRSVAARQA, (SEQIDNO:5368); XM_014118359.1, COL11A2, Ins, C_7, PKAGRGAVGACVLHGL, (SEQIDNO:5369); XM_849386.2, TMEM119, Del, C_7, PKAPVLAVSPPRS, (SEQIDNO:5371); XM_546575.3, VMO1, Del, C_7, PKASPEMTR1, (SEQIDNO:5372); XM_014122040.1, BRD4, Del, C_7, PKCYCRRTKSHLPRPSPLCRCSSTCSSCRRCSPPHHYSLP, (SEQIDNO:5373); XM_003432681.3, KMT2B, Ins, C_7, PKDSCPETG, (SEQIDNO:5374); XM_005629518.1, EZH2, Ins, C_7, PKEEEEETPVVGGTLQKDTAEKGRL1, (SEQIDNO:5375); XM_005639643.2, CCDC80, Ins, C_7, PKEEGCAGAQGGAPRAPRAAAHQRGPREA, (SEQIDNO:5376); XM_014113940.1, VPS9D1, Del, C_7, PKEGWTAALWGLPHPWRTASRLYRAKTAPLKTSNTSWLLLRGGAGGMGGHLSPKQ QG, (SEQIDNO:5377); XM_005619042.2, ZSWIM8, Del, C_7, PKGPTTWL, (SEQIDNO:5378); XM_014109614.1, ARID3B, Ins, C_7, PKHGRQCQRQQQLSLLPEPYLVPGHPQRRAVHQLVPL, (SEQIDNO:5379); XM_014117011.1, PKN3, Del, C_7, PKHVPRLQPHPGELPSLPRPVMSHPRRAPWEKR, (SEQIDNO:5381); XM_005640903.2, IGSF9, Del, C_7, PKKSQVLSELSLGPQPSTRPGPMTAAAAVPAGCPSPSALQTSALWGPLPQPHLVLCR VQDPCSST, (SEQIDNO:5382); XM_860093.4, EWSR1, Del, C_7, PKLDPTARLQVNIANRAAATGSRVHSDRTTPVAWVFMGRSLEDFPDQERTGA, (SEQIDNO:5383); XM_005625887.2, CSNK1E, Ins, C_7, PKLLACGLDSGAPVL, (SEQIDNO:5384); XM_014110888.1, SPEG, Del, C_7, PKLPHESTGACSLPSKQSPPHPVPRPPRVSPSLPSLTLGPQPQPPPLRGRNQRPPLLPCT W, (SEQIDNO:5385); XM_543052.4, MOCS3, Del, C_7, PKLRGHALVYSSR, (SEQIDNO:5386);

XM_005632193.1, CIDEC, Del, C_7, PKNRVLGTNCPSPISLPRRLMWLK, (SEQIDNO:5388); XM_005616113.2, SSC5D, Del, C_7, PKPHTQPLTLQ, (SEQIDNO:5389); XM_548160.4, GPR179, Ins, C_7, PKPQLTHLHLPLGECRTASQERKCGSGSSLR-PRAKQPVPCPSSGQALESPLCCSRKKG HWREWGGHRGWTCPRGS, (SEQIDNO:5390); XM_844620.4, C5H17orf74, Del, C_7, PKPSPPSCR-SAGPQAAMQATRCMTAWS, (SEQIDNO:5391); XM_547871.5, DCAF5, Ins, C_7, PKQARQYLHWRRQL, (SEQIDNO:5393); XM_005633023.2, TICAM1, Del, C_7, PKRGRWAPTTPWNALKCWQPPALCPCPLEMLALSR-TRPHSHF1, (SEQIDNO:5395); XM_534785.5, ZNF385A, Ins, C_7, PKRGWCSPSSFHGEWTGSSP-GIPRETAWLPISSQHSGDWSRYNQG, (SEQIDNO: 5396); XM_014117075.1, DENND1A, Ins, C_7, PKSGAVPGAPPQCCPSSTHRTAATTQPGPRGCK-HRQRCPAGPPGPSSHSVVRQCSSP RPFSPKCSH-LIHPPV, (SEQIDNO:5398); XM_531943.5, ADAMTSL1, Del, C_7, PKSPRSWKTSGHCFQPLDRTFLQC, (SEQIDNO:5399); XM_543487.4, PLA2G3, Ins, C_7, PKSQP-PEPSPQQASTEAASSEAATTTERV, (SEQIDNO:5400); XM_005640788.1, NUAK2, Del, C_7, PKSRGCP-SIAKASSNTMVLSPFPSFKPGPSLLDSLLGI, (SEQIDNO:5402); XM_005636451.2, OSBP2, Del, C_7, PKSRGVSAFLTNPTTALISGAS, (SEQIDNO:5403); XM_544457.2, RAB42, Ins, C_7, PKTAAPRSLPV1, (SEQIDNO:5404); XM_014110333.1, SLC12A7, Del, C_7, PKTGRAMRTTWSSWRS, (SEQIDNO:5405); XM_548202.5, SPATA20, Ins, C_7, PKTKGGAQRPR-SPPWFRKGQLLPGQGPQCDSQQFST-HAYWREGKPDQLLPIRTPEGP QPPDQ, (SEQIDNO:5406); NM_001048116.1, ARSJ, Del, C_7, PKTPEVTLGSMEESGDHGIRRNTRKRSQA-KIRLRKSRRKVRQRRNSRKQVRFQIAVQ VFA1TVD, (SEQIDNO:5408); XM_005636789.2, EIF4B, Ins, C_7, PKTQTESKASEYS, (SEQIDNO:5409); XM_005625887.2, CSNK1E, Del, C_7, PKTTGLWSGLRGPSS, (SEQIDNO:5410); NM_001204441.1, P2RY11, Ins, C_7, PKTWSPSP1, (SEQIDNO:5411); XM_014106637.1, DLEC1, Ins, C_7, PKY-HYPPSFLHCQEQ, (SEQIDNO:5414); XM_003432562.3, DBP, Del, C_7, PLAGERCLGCGAFCRGPANPKSQPAVS, (SEQIDNO:5415); XM_545660.5, INHA, Del, C_7, PLAGPCC1WPPPPSLC, (SEQIDNO:5416); XM_852173.4, LOC485469, Del, C_7, PLAGTCPQRRKPMKMC, (SEQIDNO:5417); XM_846593.4, KLHL38, Del, C_7, PLAGWTRSCQMGCSSKTMTSPLNC, (SEQIDNO:5418); XM_005641878.2, FGF13, Del, C_7, PLAHRNTL-CYGKIPSNLRN, (SEQIDNO:5419); XM_005623276.2, NFATC4, Del, C_7, PLALTWTSHHPGPLTPPIPMKTLL-MKLLTCQKASAMAHPLCTPRRGPHRPTDLACGC SLRPGVPQ, (SEQIDNO:5420); XM_548302.6, CORO6, Del, C_7, PLAPAAASRPATPPCRSSTPWRRCWRRSRP-CASRCRPRSSASRPWRTCCASWWTAPT, (SEQIDNO:5421); XM_540000.4, LOC482885, Del, C_7, PLAPPLP-PRLPLSPLPPPVPPPRPRPLPPLPLRLLAPLPPSQPASLPA-PRPPPPARQRPGR STCPGSSSATS, (SEQIDNO:5423); XM_014115355.1, TRIM46, Ins, C_7, PLATCLALHHRV-PAYRCACPARPRPLAAAGRGEGHQCPAREP, (SEQIDNO:5425); XM_547396.5, SERTAD4, Del, C_7, PLCLYRVVPTRWILM, (SEQIDNO:5426); XM_535546.6, SIN3A, Del, C_7, PLCMKQCLRPCSQL-REFSTL, (SEQIDNO:5427); XM_014121319.1, CDC42BPG, Del, C_7, PLCVLCCCWQRARPSGSAGCRC-WASCRGCCWTHGQGPVLCTP, (SEQIDNO:5429); XM_005619930.2, MINK1, Del, C_7, PLCVTCTPCEPS-SSSPGPSQREPPSLPGLRSSLTSLTRVLSRPT, (SEQIDNO:5430); XM_541537.5, DHX34, Del, C_7, PLEFG-NASSPPTLLRPLSPLMGSAL, (SEQIDNO:5431); XM_005637886.1, NSMCE4A, Del, C_7, PLESGPRPGR-SPPPPPPRRGPGDPGLAALLQVITPARTCSRVM-STFPQTLFFVCLVFCF FFFA, (SEQIDNO:5432); XM_533751.4, LMCD1, Del, C_7, PLESPRNWVC-STWSSSQKRSSQ, (SEQIDNO:5433); XM_014117067.1, RABEPK, Del, C_7, PLETAPVLGLATAVHIYPQLVM-PREGRSSLLGEQIRTGASQMCTPWIWEHTGGT, (SEQIDNO:5434); XM_544038.5, SLC18A2, Del, C_7, PLGACSMSLWGRQLRSWCWLPWCSWMELF-SSVCSSHPGSSQRARRGHR, (SEQIDNO:5435); XM_014116429.1, SHISA7, Del, C_7, PLGAPRCPQSLP-PAPAWPRPTPTCC, (SEQIDNO:5436); XM_014122069.1, KIAA1462, Del, C_7, PLGEQTPTA, (SEQIDNO:5437); XM_014108793.1, SORBS1, Del, C_7, PLGLLSLKR-TALHGSAPPPVPPRTPST, (SEQIDNO:5438); XM_538253.4, 42438, Del, C_7, PLGPPAAPRLP-GACGRSCLSAVVTQSCTSLDSCGHQMPVPVPI-LAERLS, (SEQIDNO:5439); XM_014107055.1, LOC106557703, Ins, C_7, PLGPR-RHRQPIPRGCQTSSTLRGRQPPDGDLRTPARDWQR-PRWGRRRSRQHGQPPN RA, (SEQIDNO:5440); XM_003431483.3, KIAA1644, Del, C_7, PLGQLAPGMGWWQVAARNI, (SEQIDNO:5443); XM_014117646.1, LOC106559457, Del, C_7, PLGR-GRTSCHFTGHFLVLATHHLRAALPRP-TALPLYLKSQPAHRPRFQAF, (SEQIDNO:5444); XM_014121887.1, MAP4, Del, C_7, PLGR-SQPSPRQRPKLAPPLQPVASVATPPWQGVVTKGR-PRPWTARSRRQAS, (SEQIDNO:5445); XM_014121877.1, MAP4, Del, C_7, PLGR-SQPSPRQRPKLAPPLQPVASVATPPWQGVVTKGR-PRPWTARSRRQI, (SEQIDNO:5446); XM_005625905.2, ELFN2, Del, C_7, PLGRWSGPASSRPRTRRAPTTRS-SAS, (SEQIDNO:5447); XM_005621773.2, RHBDF1, Del, C_7, PLHCMWGRASWACRRS, (SEQIDNO:5448); XM_005628310.2, OPLAH, Ins, C_7, PLHHTAAGGC-CLSVFQTRPGGCLPGGCGD, (SEQIDNO:5449); XM_540889.5, RCOR2, Del, C_7, PLHLPPPCPSRPHC, (SEQIDNO:5452); XM_541489.6, MED25, Del, C_7, PLHNLGPHPWRARWPQVG, (SEQIDNO:5453); XM_544931.6, ADARB1, Ins, C_7, PLHPQQASAQRHQQRGSAAAGEGTQLQRQLDG-GRRGH, (SEQIDNO:5454); XM_005617918.2, KIAA1522, Del, C_7, PLHRGAVG-GAPPVGAALLRPQIQSAFGAVGSCLAGVCPYVS, (SEQIDNO:5455); XM_005638951.2, LOC102156742, Del, C_7, PLHSAPSPDMPRTQALLLAAPSLGD-SPASAASASGGPASPGAACSLHPPPSPSAKPAR PPSSSRIHRLDRPT, (SEQIDNO:5456); XM_540737.4, PTPRJ, Del, C_7, PLIQFLTFE, (SEQIDNO:5458); XM_014112281.1, GCNT4, Del, C_7, PLITLRYS-LAVLILF, (SEQIDNO:5459); XM_532616.4, PARP2, Del, C_7, PLKLPSQVTCLGKESTLLTCLLRAPITASLLA, (SEQIDNO:5460); XM_855886.5, NOVA1, Del, C_7, PLKPAAPRGPIRAKTASIF, (SEQIDNO:5461); XM_533608.5, MYBPC2, Del, C_7, PLKPLLHSPPKKPHLRTSPPLPRSPLGFS, (SEQIDNO:5462); XM_549021.5, FGD1, Del, C_7, PLKPPASVLHH, (SEQIDNO:5463); XM_014121827.1, PTPRS, Del, C_7, PLKTLNVSARAPRPFW, (SEQIDNO:5464); XM_005620616.2, HSF4, Del, C_7, PLKVWSLQGPWMCWAPAIKGENGP, (SEQIDNO:

5465); XM_014113853.1, SKI, Del, C_7, PLLCPP-PLRWQPLQTPRVVGWRQSWSTCDRPWRAAWT-PRKPKRSSCTRW, (SEQIDNO:5466); XM_014110188.1, AHDC1, Ins, C_7, PLLDTQRARVGTPGTRHAEHLPL-PAPGAGLPTARWESRRFWWPGRGPRSQGSPMLL Q, (SEQIDNO:5467); XM_005627280.1, RAB44, Del, C_7, PLLERGHLPWSLPWRGLSLGMEQSLRST-GAAPPPQWS, (SEQIDNO:5468); XM_014118198.1, ZNF581, Del, C_7, PLLGQAGLQNLDLPHPQDCPRLP-PLRSPATTCSLTPRVSPTRCWWTRSLRGSPGQTG LQPRKSVTAAPCAPGSSSTCPTCSDTASPTRR, (SEQIDNO:5469); XM_014110912.1, BARD1, Del, C_7, PLLGWERSLGITLRAKFFGL, (SEQIDNO:5470); XM_005627027.2, MAPK14, Del, C_7, PLLIS-LTGCQAMRQETTFSL, (SEQIDNO:5471); XM_014116271.1, UBE2O, Ins, C_7, PLLLPLPVQWP-PEPQPV, (SEQIDNO:5472); XM_014122593.1, MCM10, Del, C_7, PLLLPVRGKLIKSCKMN, (SEQIDNO:5473); NM_001313776.1, CKM, Ins, C_7, PLLPGRAPGSGETLHRSPQQPDRRVQGEILP-SEEHDRAGAAAAHRRSLPVRQTRVPT AAGLRHGPR-LARRPRHLAQ, (SEQIDNO:5474); XM_005638006.2, TOX, Del, C_7, PLLPSRSAHLFTSISTCSST-SHSPCSSPLGTSSPCRSSLPYTHRPCSRDLLFNPTIRL, (SEQIDNO:5475); XM_005626753.2, PIGO, Del, C_7, PLLRLTWIMWFLKSTDICRRSSGAV, (SEQIDNO:5476); XM_014113971.1, RLTPR, Del, C-7, PLLVPAPA-HEEPAPPQTAWASQRTLAWAPGMKMAN, (SEQIDNO:5477); XM_541071.3, SERPINB10, Del, C_7, PLNLMQTIHSSSSSGTTKLLAFSFMGDSAPP, (SEQIDNO:5479); XM_005620862.2, B3GNT9, Del, C_7, PLPANAAFGPGPVPGCPWDPAPSPGGPGVR-GRAAPKGQACRTPRSDVGARAPAART, (SEQIDNO:5481); XM_532077.5, ABHD16A, Del, C_7, PLPAP-GIRTINPVPWRSMLTASWHWLQSSGPSLITPLPSPSS-TYTGKVT, (SEQIDNO:5482); XM_014116580.1, PNMAL2, Del, C_7, PLPAPGRPPRLTAGLPAPVSPR-LAGGGATRG, (SEQIDNO:5483); XM_003639249.3, ACE, Del, C_7, PLPATTLTGGIFEPSIR-GSVLQLPEMKPTLTPELSFTSQM, (SEQIDNO:5484); XM_539499.4, NOD1, Del, C_7, PLPCAESARPCGHTCL-PACGPT, (SEQIDNO:5485); XM_014114432.1, SLX4, Del, C_7, PLPEGAALARESPERGPLGPACRRAAGQAF, (SEQIDNO:5486); XM_539044.5, BACH2, Del, C_7, PLPGPPAWRDPGACPPPPV, (SEQIDNO:5487); XM_014110676.1, CSRNP3, Ins, C_7, PLPGRQPLGHRVLLVGRRRRRALHQPVPRPQAQP-PAGGIPLVLEGAPPGRVRVPVAR GRPP-PRAPRGEAFESGRQEQTARRVHHVPRGGDGPRV, (SEQIDNO:5488); XM_014119889.1, BRAF, Del, C_7, PLPHCLAHSLM, (SEQIDNO:5489); XM_014115410.1, CRTC2, Ins, C_7, PLPHIDPWSLPPPPPRAPQPPE-FARGPS, (SEQIDNO:5490); XM_014114925.1, ARL8A, Del, C_7, PLPILTLPCSQDSSMRT, (SEQIDNO:5491); XM_014112423.1, KIF7, Del, C_7, PLPLSPPPPPPA WAPSARATGPAPTPPTASCASCRPSPGCPAPPSAK-CATGCAPWRASAAP, (SEQIDNO:5492); XM_005635886.1, SOX7, Del, C_7, PLPNTPALMPWIS, (SEQIDNO:5493); XM_005627317.2, FOXP4, Ins, C_7, PLPPHPAQWTAHCAHTSERQLLP, (SEQIDNO:5495); XM_005622192.2, ELF3, Del, C_7, PLPPPLEPMTIVS, (SEQIDNO:5496); NM_001284456.1, CX3CL1, Del, C_7, PLPPPPPFHTQPQPRTGLTPKADLCGSRETIPRQRIL, (SEQIDNO:5497); XM_846233.4, PPFIA1, Del, C_7, PLPPQDRSA, (SEQIDNO:5498); XM_005620011.2, VAMP2, Del, C_7, PLPPRLGREAPRRPLQT-SPVTGDCSRPRPRWMRWWTS, (SEQIDNO:5499); XM_005631472.2, RE1A, Del, C_7, PLPPRPPKPGKGR, (SEQIDNO:5500); XM_005630688.2, NOTCH2, Del, C_7, PLPQPMLSMHCPSLTCMKCSRWLMVPAL-CFPQLASCCPTTTLLPQATAVQGAWVGS ILSLFRQIG, (SEQIDNO:5501); XM_005618689.2, GAK, Del, C_7, PLPRAAAPGSRRVGPRPRAPRGPPRPSRPPRPVR-SQGLTMLPT, (SEQIDNO:5502); XM_005635865.2, INPP5D, Del, C_7, PLPRRSRPGFSPRGRERRGMILLIT-SPMTST, (SEQIDNO:5503); XM_536182.5, AKAP13, Del, C_7, PLPSAVKVHRLMQPPLAL, (SEQIDNO:5504); XM_014108967.1, PDZD7, Del, C_7, PLP-SHPLSLPGPQGLTGC, (SEQIDNO:5505); XM_545710.3, USH2A, Del, C_7, PLPSPHSHHTPSMCPGRSPRRM, (SEQIDNO:5506); XM_014109374.1, PYGO1, Del, C_7, PLPTLRGNKSTAYFPWV, (SEQIDNO:5507); XM_856804.4, PHF21A, Del, C_7, PLPTPPPLRRPTPPP-PRAAQRTVPRGTRLN, (SEQIDNO:5508); XM_843373.4, AGAP1, Del, C_7, PLPTRPHLSGSSP-SAAPTFSPLGKGVTQTKRRKAWKAERTASGA VEP-SQLNRACC, (SEQIDNO:5509); XM_536288.4, PJA2, Del, C_7, PLPVTARRMPP, (SEQIDNO:5510); XM_014120337.1, BIRC6, Del, C_7, PLQCSVTTDCP, (SEQIDNO:5511); XM_536455.5, CYFIP2, Ins, C_7, PLQDHLQTPGLPGHRSGHGGTAEDCQEL-APRNHSPVRENTDRGDAQDMPLTPT, (SEQIDNO:5512); XM_014116490.1, GAS2L2, Del, C_7, PLQEAAF-QVLQVEVL, (SEQIDNO:5513); XM_005623751.2, BTBD7, Del, C_7, PLQKPCLQIWTLL-WPSIHPCPHHHLHTTPQPPQSITNSKQAGNKDL-PASTLHAHSLIPV IIHCFT-PEQPLKLVPLQSTCQVLKQQHLIAPTPQD, (SEQIDNO:5514); XM_014116630.1, GSK3A, Ins, C_7, PLQLQSWRTLHPAISQRHSHPSSLEVPSGHCLPHSILT-SFK, (SEQIDNO:5515); XM_014113233.1, DNAH9, Del, C_7, PLQLSATSRPR, (SEQIDNO:5516); XM_005634662.2, EDN3, Del, C_7, PLQPDLRGTSRSLWP, (SEQIDNO:5517); XM_014107411.1, WASF3, Del, C_7, PLQPRQSARRRHSHP, (SEQIDNO:5518); XM_005642194.1, AEBP1, Del, C_7, PLQWTITSGLPDPRNPTRTWRQMKRRRS, (SEQIDNO:5519); XM_014118769.1, WFS1, Del, C_7, PLRAP-LAHSLHHRSPRPARGSMPLPRWNRTRG-GRPVLRDQTLPMRLPPLQPGPQVLG ARKGRTEQGP, (SEQIDNO:5520); XM_014118768.1, WFS1, Del, C_7, PLRAPLAHSLHHRSPRPARGSMPLPRWNRTRG-GRPVLRDQTLPMRLPPLQPGPQVLG ARKGRTE-QVRGWGCKLTILSATSAA, (SEQIDNO:5521); XM_014113911.1, RERE, Del, C_7, PLRAPTLLLLSTRA, (SEQIDNO:5522); XM_014115765.1, EFS, Ins, C_7, PLRCPFQPETGISRAQSVRSARGTASRWGMWRH, (SEQIDNO:5524); XM_005616873.2, CD3EAP, Del, C_7, PLRCRNPW, (SEQIDNO:5525); XM_014117108.1, LOC106559343, Del, C-7, PLRPGRRPPS, (SEQIDNO:5526); XM_014110586.1, RREB1, Del, C_7, PLRPPR-PARSSPPRRCSPGTGRSRQPVTGR-SARSSPLGTGTRTPTAPRTTRSATRAWTS TSPAG, (SEQIDNO:5527); XM_014114743.1, AXIN1, Ins, C_7, PLRRRGLRGTAGRTRGEPREHPG, (SEQIDNO:5528); XM_545232.5, EPHB3, Ins, C_7, PLRSCEHHHQPGCSI, (SEQIDNO:5529); XM_014113910.1, RERE, Del, C_7, PLRSLWTLPHSCSNLSKRKTMGSVGSIA, (SEQIDNO:5530); XM_847374.4, HOXD1, Ins, C_7, PLR-SQYHQVWKEPGEPFSGPGALM, (SEQIDNO:5531); XM_546778.4, ANKRD11, Del, C_7, PLR-TEMNCWPHPWREPFPLIWAFPWMPQRTSR-PLPPSSPQSPATWSHWMRAPSARS

SRRNPSSGHIRRPQSRASPAV, (SEQIDNO:5532); XM_014109357.1, NUTM1, Del, C_7, PLRVLPVNS, (SEQIDNO:5533); XM_005627265.2, SRPK1, Del, C_7, PLRWRRASPPASGLPVRAHQPRRPSAPAALAPCSPPGRPASWGRCRARRSATRADGPPAP, (SEQIDNO:5534); XM_014111168.1, SPEN, Del, C_7, PLRWSLRSLF, (SEQIDNO:5535); XM_005617949.2, ATP13A2, Del, C_7, PLSGASLPPSSSCRWNPLQP, (SEQIDNO:5536); XM_014107094.1, HSPG2, Del, C_7, PLSGSNHRPPTWRKGRLWI, (SEQIDNO:5537); XM_005633593.2, COR52H9, Del, C_7, PLSILLSME, (SEQIDNO:5538); XM_540880.5, MAP4K2, Del, C_7, PLSLQRKTLYPALWEPHLHLSQALPTPLCSPLPGLP, (SEQIDNO:5540); XM_014121529.1, THSD7B, Del, C_7, PLSMVGPSVPT, (SEQIDNO:5541); XM_003639867.3, ZFP64, Del, C_7, PLSPRGARARRAR, (SEQIDNO:5542); XM_852921.4, BRD3, Del, C_7, PLSPRRLSLLPPLCQPLLQTSHRSLFPRPPPHLLPRRPSSLWSLPHRLSSRKRV, (SEQIDNO:5543); NM_001002933.1, HCRTR2, Ins, C_7, PLSQMCSGAE, (SEQIDNO:5544); XM_844466.4, MAZ, Del, C_7, PLSRETPPSHSPPV, (SEQIDNO:5545); NM_001097547.2, PADI6, Del, C_7, PLSRWKGKSTP, (SEQIDNO:5546); XM_014118288.1, LENG8, Del, C_7, PLSSCQQPSPLSPPTPRMGLML, (SEQIDNO:5547); XM_014118308.1, PRRC2A, Del, C_7, PLSSPPPLQVWLQLPPW, (SEQIDNO:5548); XM_014118001.1, PHF19, Del, C_7, PLSVSTVCCLTSSSSRKGEFIEEKDQSFCWKMLFPVATLPPPGAPTTTWPASLTSRWM KFRA, (SEQIDNO:5549); XM_005630709.2, BCL9, Del, C_7, PLSWGLLLLRLFTSSLHHFLPRHLDGPPLQNLPFRVPGSLQTIKHPSPWPPQPCWAV, (SEQIDNO:5550); XM_014109795.1, EVA1C, Del, C_7, PLTACLTQLCKYYPGGAMGSRDAKSRSTITISGAPVCQE, (SEQIDNO:5551); XM_005622656.2, CAPN2, Del, C_7, PLTCSGSSRRLCRKAPSSAAP, (SEQIDNO:5553); XM_005623558.2, PLEKHH1, Del, C_7, PLTHLPPTSYGNWTDSSSLLLSHVLPEGQRCC, (SEQIDNO:5554); XM_003431800.2, ZNF16, Del, C_7, PLTISSQIGTPGLRARNFFRRKKFLRIWNPRKKYQKTIPVIFPRCLSLENSVMMY, (SEQIDNO:5555); XM_014115410.1, CRTC2, Del, C_7, PLTPHRPLEPPPATAACPSAP, (SEQIDNO:5556); XM_005626204.2, SBF1, Del, C_7, PLTQASCGPSAQPSTSSGIKRSSRASGQTPCSSGSWCPSRCLRPRPRIHIPPTPTPWTM QISILSSLRPVAPF, (SEQIDNO:5557); XM_849952.3, INTS5, Del, C_7, PLTSVHPHPPMSLLGDLV, (SEQIDNO:5559); XM_545662.6, SLC4A3, Del, C_7, PLTWPVSAVVPHQVQGCHGASSAPRAPGRGSPESLERRAGPGARRPATTCGSGCAP AVPWAAQVARSSRCPPTRRRPRCWAPRTWTT, (SEQIDNO:5560); XM_005632733.2, HAUS8, Del, C_7, PLTWTSRPSMTKVCLERLRN, (SEQIDNO:5561); NM_001002933.1, HCRTR2, Del, C_7, PLVATGHLLRS, (SEQIDNO:5562); XM_532130.5, DNAH8, Del, C_7, PLVLKILPFRVWIQEMRLFPVQERLLLLQTKRVSALQQRLPQL, (SEQIDNO:5563); XM_014113364.1, ARHGEF12, Del, C_7, PLVQTHKARSWSTFVRSRLT, (SEQIDNO:5564); XM_014107649.1, LOC106557788, Del, C_7, PLWGTAGSQPQEPRPPGRGGGAPLLGPPACTQNPGC, (SEQIDNO:5565); XM_531841.5, B3GNT2, Del, C_7, PLWPTGTENKKS, (SEQIDNO:5566); XM_545182.4, ICE1, Del, C_7, PLWYPYHP, (SEQIDNO:5567); XM_014115375.1, EFNA4, Del, C_7, PLYLCGSFHCTLSCGAKDMLSPGPQLSGLS, (SEQIDNO:5568); XM_014117368.1, TRIOBP, Ins, C_7, PLYTSSCVHWSSRCSPGFFTPPPHPV, (SEQIDNO:5569); XM_014114935.1, PPFIA4, Del, C_7, PMAPMLTPTSSS, (SEQIDNO:5570); XM_547389.5, PLXNA2, Del, C_7, PMEGSSTRWSLCSKTEARSSGTWPSPLISATCTSCLRDRSPGSPWNPANSTRPVGNV, (SEQIDNO:5571); XM_547651.5, THOC1, Del, C_7, PMEKDFQRW, (SEQIDNO:5572); XM_014122486.1, TENM4, Del, C_7, PJMEPCTGQT, (SEQIDNO:5573); XM_014113768.1, ACOTL1, Del, C_7, PMPITKAIPLGARSWPGWRTWPPLQPAGCAVPTLR, (SEQIDNO:5574); XM_005639382.2, COL8A1, Del, C_7, PMPMGLRKARTEGQPTRCLPSQLS, (SEQIDNO:5575); NM_001007126.2, DIO1, Ins, C_7, PMPRGGGHDEEPKQPVLRGPTREALRAPGGQDPLQG, (SEQIDNO:5576); XM_534923.5, FKBP4, Del, C_7, PMPRLCLRWSCSSSGERT, (SEQIDNO:5577); XM_005628976.2, GJB4, Del, C_7, PMPSPRESPPRTGTLSS, (SEQIDNO:5579); XM_005634916.2, MYLK2, Del, C_7, PMQRKNPGPHNQRKSLTHPPCRKMPKLLP, (SEQIDNO:5580); XM_014121104.1, CNTF, Del, C_7, PMRLMGYLSLEMVASLRRSCGA, (SEQIDNO:5581); XM_014119548.1, MYPOP, Del, C_7, PMRQAAGRRRRGAPWPRRRRARRRRPPGCASRASRSRRTRS, (SEQIDNO:5582); XM_014119121.1, NTN5, Ins, C_7, PMSLPPPHHGPGV, (SEQIDNO:5583); XM_005618685.2, GAK, Del, C_7, PMTPGTLCSTTSSAPR, (SEQIDNO:5585); XM_014107013.1, PEF1, Del, C_7, PMVEDSMA VGYPQVVAMEGVLPPEGLMDHQLVGDPMGGSPLELQEDYMVVRPRGAPMVSHLQI PTVPSILGLMDRDLLQVSQWTPITVATSPSRS, (SEQIDNO:5586); XM_003639958.3, ATN1, Ins, C_7, PNEVSIFVLW, (SEQIDNO:5587); XM_846736.4, PITPNM1, Ins, C_7, PNHLLWGAQAGKHSLLPTCRHF, (SEQIDNO:5590); XM_005624843.2, KSR1, Ins, C_7, PNHTPAAKAHQAEASADTTPAQPQGLSAAAQLPHTHPEQVP, (SEQIDNO:5591); XM_014108723.1, FAM186B, Del, C_7, PNLHPTLSH, (SEQIDNO:5592); XM_846083.4, SUFU, Ins, C_7, PNMASRANAGLGQIRVPVREHLLQRGPRVLA, (SEQIDNO:5593); XM_014119360.1, CCDC9, Del, C_7, PNMEAGQAWAGQPTAGRTVAGSSLEEELGAVAGEAGAEGPLIFLELEIPQWLTANL RSGRSGGGRTSRR, (SEQIDNO:5594); XM_546088.5, DISC1, Ins, C_7, PNPCWLSGCLYVKL, (SEQIDNO:5595); XM_005616581.2, DYRK1B, Del, C_7, PNPDALVVPHHQPHHHPRS, (SEQIDNO:5596); XM_005622972.2, ADCK3, Ins, C_7, PNPPSGSCRETIPSYADRPQLVQLFL, (SEQIDNO:5597); XM_014116624.1, HOXB3, Del, C_7, PNPPSRPPRTWRAITSARRARCSPWATPPRRPRARSSTVAA, (SEQIDNO:5598); XM_014114048.1, ZFHX3, Del, C_7, PNPSSSSSHRCSRRRPQLSHHPHHSSHRNSSNSNARTKTARR, (SEQIDNO:5599); XM_548149.4, STAC2, Ins, C_7, PNPVAPSLPTTGIYRWGPPSPGPLPLPHPTAPGTAQTGQTAQLPGTRLQESQPL, (SEQIDNO:5600); XM_014118241.1, NOTCH4, Del, C_7, PNPVPMEAPA, (SEQIDNO:5601); XM_014111977.1, IGSF1, Ins, C_7, PNSGPETANPVQRMAGRHGVRSV, (SEQIDNO:5602); XM_014106932.1, LOC106557687, Ins, C_7, PNSGRRTEAWRAGRGPGEPVGPASLLRAAGPSTWTAPSTGPGPAAAGAAGASKRG QVPGPAPMSQRGRRRSGVGSAGQRRQTQGRRR, (SEQIDNO:5603); XM_014116196.1, HGS, Del, C_7, PNSHPLWPSRRLRRALLHRAARPSSSRLT, (SEQIDNO:

5604); XM_005626284.2, FLT4, Ins, C_7, PNSKHHGGDTHH, (SEQIDNO:5605); XM_014110888.1, SPEG, Ins, C_7, PNSPTKAQGPAACPASRAHPTQCPGHPE, (SEQIDNO:5606); XM_014121455.1, PCDH10, Del, C_7, PNSSAPALPYSPSECWTPTTTCPPSTNPSTLCPCPRTRHPARS, (SEQIDNO:5608); XM_003638913.2, PCDH1, Del, C_7, PNTPASSYLTAASPSPPPVRPKSCRTHPSTVTMTVAWRSLRRHPASHPRDPDSVRWL CLRITMNAPPLMAA, (SEQIDNO:5609); XM_003434578.3, RNF214, Ins, C_7, PNTRDSSFQTGVGDKAEWSSDDEKECSGPI, (SEQIDNO:5610); XM_848227.4, C1S, Del, C_7, PNTSSMKI, (SEQIDNO:5611); XM_860093.4, EWSR1, Ins, C_7, PNWILQPGSKSI, (SEQIDNO:5613); XM_003435655.3, NKRF, Ins, C_7, PPAAAVAAPPAAPARASAGAVAL, (SEQIDNO:5614); XM_014122607.1, C21H11orf16, Del, C_7, PPAANCCARAASAVAPWLDLPGGL, (SEQIDNO:5615); XM_014113201.1, MLLT4, Ins, C_7, PPAAPGLRRHLSLHLIPAPlGPSQQYCSQSRPAPTPSKKTRLLPAQPLERTKLLPGICR DSCWHPRCLSGPERKTV, (SEQIDNO:5616); XM_005626257.1, LOC102155231, Ins, C_7, PPAAPRGSGHLWGWIPPPPRPGHCCYRGSDPSSSREYRPHCRTGWSALQP, (SEQIDNO:5617); XM_014115096.1, PROX1, Ins, C_7, PPAATTSPCTSRLSLPPRASPRPPSATPSPFP, (SEQIDNO:5618); XM_005633132.2, DAZAP1, Del, C_7, PPAAVALDEVRTTTCKDSTRTDA, (SEQIDNO:5619); XM_014122263.1, SHC2, Del, C_7, PPAGRPSPPRRSSCGRNPGTNIAR, (SEQIDNO:5620); XM_539768.4, FHDC1, Del, C_7, PPAGTASPGTGPPRGRMRRPPRGARSEKRPRAPPRPALPGAASRRPPRPCAP, (SEQIDNO:5621); XM_014114721.1, CACNA1H, Del, C_7, PPAPGLRPRRAQTPLASWLYARCPCPGCCPCPTTATCSGPWRPPRPHTPAHCGKWTQ RRAQAQPPPAR, (SEQIDNO:5623); XM_014114724.1, CACNAIH, Del, C_7, PPAPGLRPRRAQTPLASWLYARCPCPGCCPCPTTATCSGPWRPPRPHTPAHCGKWTQ RRAQAQPPPVQAR, (SEQIDNO:5624); XM_014121756.1, LOC106560089, Del, C_7, PPAPHPGVVVPCYSSRCRQGTFPGSLAPGLRPGEPAGQGVTPPRVEGASFPEVTGAG GCRLVQATAHFP, (SEQIDNO:5625); XM_003434697.2, CMTM3, Del, C_7, PPAPRGPGSAPSCPRAPSCARAKAASCWPSRASRSSPLSAMWHPRHPPSWQRLCWSS SWPSTSYSLMPCS, (SEQIDNO:5626); XM_541489.6, MED25, Ins, C_7, PPAPTTCPVLAHTASPESSAARSDAAERGSPGPGSPAGPAAQRHGGRHPHGSHL, (SEQIDNO:5627); XM_853531.4, ARPP21, Del, C_7, PPASSPCEGQ, (SEQIDNO:5629); XM_540140.5, GALNT14, Del, C_7, PPASSSPSTTRPAPPCSEPSAAY, (SEQIDNO:5630); XM_005635170.2, CEBPB, Del, C_7, PPASWAAASATT SAPSTSARTWSRWARRRPRRRPQPRTPSRRPRPRPPPRPPPPGSTTTS SPTSSPTTTEARTARRRPSTAT, (SEQIDNO:5631); XM_547146.4, NMRAL1, Ins, C_7, PPAVDSAARSQEAGGGRGARFSPPASPTRAAAGGGGRAGVGVPSASRG, (SEQIDNO:5632); XM_014109869.1, COL18A1, Del, C_7, PPCCLEPHSQLSPGAGALGLLPPRTLWGLGLLITPPR, (SEQIDNO:5633); XM_014116236.1, FAAP100, Del, C_7, PPCCPSRTASACP, (SEQIDNO:5634); XM_014115267.1, ENAH, Ins, C_7, PPCIWIFCGIRVRRQSPFDWTCGCHRRSETEESVPDGGCLFPRRRCEPSLI, (SEQIDNO:5635); XM_848542.4, LURAPI1, Del, C_7, PPCRPPPRPLQPPAPHVAAPAAPWRGWKPSCTSSGRRWLTSEPQMSGSCASCLLSMR ALSPSSG, (SEQIDNO:5636); XM_014117863.1, PAX5, Del, C_7, PPDRAATQHRR, (SEQIDNO:5638); NM_001003008.1, RHPN2, Del, C_7, PPDRWGSCLPGMTPSPGSR, (SEQIDNO:5639); XM_005634296.2, ZBTB47, Del, C_7, PPFILPIPCQGPGPATLKAWSLRPWSGPASPAPCGRGRPEEATSCWLRRRQTHRRPSS RWWRTWRCTSPA, (SEQIDNO:5640); XM_853188.4, RARG, Ins, C_7, PPGAGRRRGRRGNRLRVRGVPSTQLLSKPGRDVRLHGSVRPGPAPAVRGVGARGRL AAQSRGQLLLRGTGVLGLASTRQPAVGGDSEH, (SEQIDNO:5641); XM_005642222.2, KBTBD11, Ins, C_7, PPGARARGRGRGGAGGARPARGPAAAGRADTLQPRRVAVLQLRGRLPAAGSRLRR GGRSVLPALAS, (SEQIDNO:5642); XM_005616615.2, RASGRP4, Ins, C_7, PPGEWLLQPRRADGVPAPGQRHLLQAGPGLPA, (SEQIDNO:5643); NM_001048083.1, ARSA, Ins, C_7, PPGLPPVPGHPVLARPGPLPEPDLLSAVHPL, (SEQIDNO:5644); XM_014114130.1, SRRM3, Del, C_7, PPGLRSGPRAPGRPAPPRPRARTAGTAAQRGRARRAAPAPTRSRGAPAARPPSPARA PRRRGPAAPAARRRPRKP, (SEQIDNO:5645); XM_005618675.2, FGFRL1, Del, C_7, PPGPGSTPNSTRTCTRTRTRTRTHTRTRTWRARSTSTSTSTTSA, (SEQIDNO:5646); XM_014109500.1, CILP, Del, C_7, PPGPLPQALSEEECPQGDSNGLVGVASAG, (SEQIDNO:5647); XM_005631210.2, LRRC55, Ins, C_7, PPGRAAGLPPLGSRGDALGCRHQLPSPLYVP, (SEQIDNO:5649); XM_852751.4, POLR2A, Del, C_7, PPGTAHARCAPSSGCSSESSVRMN, (SEQIDNO:5650); XM_005637420.1, LOC609303, Ins, C_7, PPGWGLAAAP, (SEQIDNO:5651); XM_014110352.1, ZNF683, Ins, C_7, PPHAALRLLLPHHGCAQFADESQ, (SEQIDNO:5652); XM_014110188.1, AHDC1, Del, C_7, PPHGPCFPPGPLPAHLTRPSPTPSPRTHAHPHAGTPAPGAHQSLPRGTTRCPLGQPVPS PRPAAPLLRETATAPDVAGTTGG, (SEQIDNO:5653); XM_014122258.1, DNAH1, Ins, C_7, PPHLPVLGASDPASLLR, (SEQIDNO:5655); XM_014120658.1, LOC100686114, Ins, C_7, PPHMPRGETGSDGSNQALLSVLIALDLQPLQGLPESFWSCWG, (SEQIDNO:5656); XM_014119265.1, C15H12orf74, Del, C_7, PPHPSPQGTQLRASCAHSVYHRARYISGFPYYPSGQGVL, (SEQIDNO:5658); XM_014115490.1, KCTD1, Del, C_7, PPIPPTTTAPSRPRWGTPISSSPKTARSGPT, (SEQIDNO:5659); XM_005635083.2, TOX2, Del, C_7, PPKCCRPSSPCTPCQAWPRS, (SEQIDNO:5660); XM_014114158.1, AUTS2, Ins, C_7, PPKHTASAGARRGPAGPPASGAEAPAAAVPRPAAPSGSPACAGAPLVPGPLPAPLSL QQQ, (SEQIDNO:5661); XM_003639777.3, SYDE1, Del, C_7, PPKPPARSPPAQPGVCP, (SEQIDNO:5662); XM_014114031.1, MTSS1L, Del, C_7, PPKTCWWPSAAGCGSAGPSPTTGRRPASC, (SEQIDNO:5663); XM_014116619.1, SP2, Del, C_7, PPLCLRLTRKPGRRVSLPPSPLWLWRSKWRRC, (SEQIDNO:5665); XM_546572.6, CAMTA2, Del, C7, PPLEGVHPEEAPQSSS, (SEQIDNO:5666); XM_014119807.1, ATG9B, Del, C_7, PPLGCSAILPHLCPRPSWPTSWRSPSCPHGT, (SEQIDNO:5668); XM_014119796.1, KDM7A, Ins, C_7, PPLGGGVGQREPWQERRASPSAPAPAAAGVWASAPPSPPLPSPPQFYRNTTRPGQMS ESPSTGPGRENRLHYSVLFRL, (SEQIDNO:5669); XM_005630123.2, C17H2orf50, Del, C_7, PPLGSRKPRPLGTGCPQPGRQP, (SEQIDNO:5670); XM_014112966.1, TULP4, Ins, C_7, PPLLLPLHRLHPYHQAPNSRSQQHERLCQLPLRGQ, (SEQIDNO:5671); XM_005637152.2, ETV6, Del, C_7, PPLNCCTVLDHLSQPITGLLPTPSSGPSGPPWTT, (SEQIDNO:5672); XM_541835.5, IL17RD, Ins, C_7, PPLPRAGAGEV, (SEQIDNO:5673); XM_005624150.1, CBX4, Ins, C-7, PPLPTCTATELSLPKTE, (SEQIDNO:5674); XM_005625737.2, ZBED4, Ins, C_7, PPLRGQRGERGGEESPASQEHFGLQEAVGCVEALLPVAPGQLQGRVHPLHERVQQG QERQGPGHQLPD, (SEQIDNO:5675); XM_014122450.1, LOC106560164, Ins, C_7, PPLSFSLPKTKRGKTG, (SEQIDNO:5676); XM_014122165.1, CBARP, Ins, C_7, PPLSGQPHQPIPHSRQARGSRGGGRRGRSEPRVPPRAQRRGRAAGI, (SEQIDNO:5677); XM_014106473.1, LOC102155469, Del, C_7, PPLTLSSKGHSAPCRSQSPFPSVLLATGSGRGQPPEGR, (SEQIDNO:5678); XM_014114926.1, LOC102152085, Del, C_7, PPLVCTRCLALK, (SEQIDNO:5679); XM_540000.4, LOC482885, Del, C_7, PPMPCSACTAWRPEASGALPSTP, (SEQIDNO:5680); XM_005635994.1, LOC102152258, Ins, C_7, PPPAAGARGLCPPRPGACAAGLPGLVCGGRGAGGGPRQRGRGRPARDPRGRGWAG VRAPQGARGCAWTGPRARRGQLPGPAPARRPRRRR, (SEQIDNO:5681); XM_005621491.2, GPRC5B, Del, C_7, PPPAPRPPPPNSFPVREGGGSLERGQRPLECGGQRRPCPGRPTRHTGCPAAPGWGLG LCGRVPATEVKLGHYSVENGQAPRSPGRGQRER, (SEQIDNO:5682); XM_005638950.2, SIK1, Ins, C_7, PPPARRRLPGGIGGPAAGHPPAHQPHRGPPSRRHAAPRLCGHGAPAGGL, (SEQIDNO:5684); XM_014107180.1, LOC106557715, Ins, C_7, PPPCPLSGPGLSLQPSEASRRRHPRLRGARGTGRDVRARGKAAGLPASERRRPC, (SEQIDNO:5685); XM_014119801.1, LUZP6, Del, C_7, PPPCSFRLVSLDLEFKHST, (SEQIDNO:5686); XM_014112086.1, LOC106558514, Ins, C_7, PPPELCVPGPRAALELKICVTDLGPPGPPL, (SEQIDNO:5687); XM_014106406.1, LOC102156658, Ins, C_7, PPPGAPPHQLRASDMRRAVAAGRSLAPLPPSHASDLLSRACVQRPGSAADVEEPAA GCGDPGPRGGLSADAR, (SEQIDNO:5688); XM_014112065.1, LOC491446, Del, C_7, PPPGARSR, (SEQIDNO:5689); XM_014116470.1, RARA, Ins, C_7, PPPHLQALLCLSRQIFRLPLWGQRL, (SEQIDNO:5690); XM_539499.4, NOD1, Ins, C_7, PPPLPVPEGRWPGGGRPLQEQGSLSVH, (SEQIDNO:5691); XM_014107689.1, LOC100855783, Ins, C_7, PPPLRPPPPRLGSSHAVCSLAGLRAQQEQEKEEDRFHSLQRLRADLAPPGKSGRELED GDGGGPEPRGHQLRRDAEHAEVRRPGQADP1, (SEQIDNO:5692); XM_005631006.1, COBL, Ins, C-7, PPPLRRRPDPWQDPGEWVQVGPPPHQAPSLPGRAGHQ, (SEQIDNO:5693); XM_005633166.2, LOC102155774, Del, C_7, PPPPARGILGQKAQWPRAS, (SEQIDNO:5694); XM_003434830.3, KCNA3, Del, C_7, PPPPASRTPSSWWRPCASSGSPSSCSCASSPAPAKPPSRGTS, (SEQIDNO:5695); XM_005633811.2, LOC102152567, Del, C_7, PPPPGGGVPGPGPQRRRSTAEGLGPRASGRRGRAPR, (SEQIDNO:5696); XM_014121534.1, VHL, Del, C_7, PPPPGPPFLPGRSERLLEPPEFVTDAVGRY, (SEQIDNO:5697); XM_540529.4, DEAF1, Del, C_7, PPPPPKPCPPPW, (SEQIDNO:5698); XM_014114167.1, GTF2IRD1, Del, C_7, PPPPPPLWPASCTAPRSLTTPQESSSRRRPP AHLPPVTWALAGLGLNPRPLAPKTAVDRSPLGLVVLSSRMSMPRSASCSPSSMTSQR SGTPS, (SEQIDNO:5699); XM_005626204.2, SBF1, Ins, C_7, PPPPRGPCRSAS, (SEQIDNO:5700); XM_014113024.1, WWC1, Ins, C_7, PPPPTSLHT, (SEQIDNO:5701); XM_014116626.1, HSF2, Del, C_7, PPPQESSRGRRYQQTQLLPLVLTQMARVFWFWMNKDLQKKFFLNISSTITWQAL, (SEQIDNO:5702); XM_544960.5, NKX6-1, Del, C_7, PPPRPPRPLRRRPPPRLWAPTTQAA, (SEQIDNO:5703); XM_014120927.1, MAPK8IP1, Del, C_7, PPPRRVAAATRIEIASTIRRTCG, (SEQIDNO:5705); XM_014115697.1, LOC102152805, Ins, C_7, PPPSPLCAPPAALAAPAHLSGGH, (SEQIDNO:5706); NM_001006645.2, KCNA5, Ins, C_7, PPPWARPGDQRQRGPGARLGPHGGASPAADPG, (SEQIDNO:5708); XM_005623942.1, LOC102153864, Del, C_7, PPQALSGTGTGMGTRRTQPQTLRWTRPWTGRSLRTQSRTPRGPALSPAPGDRPRSG WAGEGRSAPPGARKASALSPKPS, (SEQIDNO:5709); XM_005642075.2, LOC100683955, Del, C_7, PPQPPAPAPAAE, (SEQIDNO:5710); XM_846788.3, SLC9A5, Del, C_7, PPQPVQRRSYPGRVGREIWQSTCPRKPPRLCPWTCRQAGTRASRPWRAWHPRPVPR PQL, (SEQIDNO:5711); XM_014118223.1, ZNF865, Del, C_7, PPQTARRRRRQRRPWYMVPCPSHCWGRTRCCSAGPGPVGPGGPAPTSLERHSAAAS VGGASGGVRL, (SEQIDNO:5712); XM_014117280.1, LOC102154639, Del, C_7, PPRAASAR, (SEQIDNO:5713); XM_003434094.4, SIDT1, Del, C_7, PPRAATPATPPGAPISTASTAGW, (SEQIDNO:5714); XM_005618727.2, LOC102156706, Ins, C_7, PPRAHGWGAPRRGRCRRWGQAPGASSWARGLWHRLASPIPRSRAGRTLGLRPRERP PLRAASRLRGWAGRASPG, (SEQIDNO:5715); XM_014108773.1, LOC102154201, Del, C_7, PPRAPHLRGGAPAAGPDGKRPSRSAAGAGRKPEAGVLAHAPSAQGRERVFRRMRRP RRAQSLGAVGVGRSWGAARVE, (SEQIDNO:5716); XM_014115267.1, ENAH, Ins, C_7, PPRASTTPSAPCFRTSTTTPSTPSS, (SEQIDNO:5717); XM_003433939.2, C30H15orf59, Ins, C_7, PPRGPGGRPQAPARPLQAQAPSADQLPPGPRRPRADPEGHKEQ, (SEQIDNO:5718); XM_005631072.2, RIC8A, Ins, C_7, PPRHLAAEHPHPVQGPKLPGPFHQPPEPAGPCLLCRHRLGGVWPGASGHGRCPRVPE VPVQPRAEQPGGTGAGSRGPPGGEARRARGAVSQE, (SEQIDNO:5719); XM_014114530.1, LOC100856086, Ins, C_7, PPRHPPGYRRWGHQWLWVALGGRERLSFQKTRARFHRGCGGCKD, (SEQIDNO:5720); XM_005627318.2, FOXP4, Del, C_7, PPRLLLLSPPFGPLASALPPCTVEALPAGGAVTSSAPPSPQSWPRIMNSTRMPMSGPLS PTPPSSARPFWKPPTGS, (SEQIDNO:5721); XM_014107689.1, LOC100855783, Del, C_7, PPRLLTRRLLSCRTPGPTRTRKRRRPISFPTETPC, (SEQIDNO:5722); XM_005636541.2, ZDHHC8, Del, C_7, PPRPARPAHPPMQAPKLSPSSTRTSQSRHPRWPCKGTTLS, (SEQIDNO:5723); XM_014109382.1, IGDCC4, Ins, C_7, PPRPDLWLQTLLAGGGGRGGGWW, (SEQIDNO:5724); XM_014112353.1, LOC106558589, Del, C_7, PPRPFPSPARPPALRGCAS, (SEQIDNO:5725); XM_014115684.1, LOC106559101, Del, C_7, PPRPVHPAWMHLAGPAGRSNDPDSPAGQDAGAAARRKGAEALSRTWALAPANLPA AARRPGALGDLGAAPPPLRLRQPRV, (SEQIDNO:5726); XM_005619461.2, LOC102153808, Ins, C_7, PPRQDLQDSHALHCQAKISSVDITSTLSSSEPSGQF, (SEQIDNO:5727); XM_014121745.1, ADGRE5, Del, C_7, PPRRWGCAAAWWPDCCTTFSWAPSAG, (SEQIDNO:5728); XM_014116364.1, LOC102155336, Del, C_7, PPRSCTGYGVP, (SEQIDNO:5729); XM_003431507.2, TOMI, Del, C_7, PPSCTTRCSTSSSPGLTRSAAHLT, (SEQIDNO:5731); XM_847603.3, LIMK2, Del, C_7, PPSFPWPPSAANWSLRADLHSQNWRTPLRLSPCTWGSWASRCLQSWRSWTTL, (SEQIDNO:5732); XM_844754.4, PLEKHO1, Del, C_7, PPSFRPTRPSCPGSRTW, (SEQIDNO:5733); XM_005639704.2, ADAMTS16, Ins, C_7, PPSGKPAGLRWGWTPLPHTIQEIHRSAGSRGSPGGPDPEGSGAGESASAQRLEPPAAT KAAFLWKTQEIHAQASQGGSLHPA, (SEQIDNO:5734); XM_843485.5, STK25, Del, C_7, PPSGQAPTASCTRGRPCTAPRSPRSLSRGSRGPSACPRWSGLSSESSRRSTSRAAGAW GHWKSWRMPSAWRRSPVLASRTS, (SEQIDNO:5735); XM_014118664.1, LOC102154884, Del, C_7, PPSGSPLREPRLRWAIARA, (SEQIDNO:5736); XM_005633193.1, TDGF1, Del, C_7, PPSMVATVSTILEKRTVSLCPMTPGCLRDVPCVNAGAAGCTAFGRHFYQGVMAT, (SEQIDNO:5737); XM_543139.5, PDS5B, Ins, C_7, PPSQIRHSLYPCDIF, (SEQIDNO:5738); XM_014121836.1, LOC106560107, Del, C_7, PPSRAAPPASSPTAAWLWVKIGSPSPSLKCTGL, (SEQIDNO:5739); XM_005615409.2, LDLRAD4, Del, C_7, PPSRCPTGRSRRPTRGPAPCSSGTPNSSGSSTASR, (SEQIDNO:5740); XM_542667.4, IRS2, Ins, C_7, PPSSAFARQARWQQRWPPRRLPDPALPGSAAHAPVPGGAADAAQHARVPSAARAQ EPRRVHQH, (SEQIDNO:5741); XM_005617128.2, BEND7, Ins, C_7, PPSSHMHTPPSRKQKQKQKKKKKKKKKVVVLSSTRKQLIRLSP, (SEQIDNO:5742); XM_005640040.2, HIVEP1, Ins, C_7, PPTERKPVI, (SEQIDNO:5743); XM_005642083.2, USP9X, Ins, C_7, PPTESDFIA, (SEQIDNO:5744); XM_846276.4, AKT1S1, Del, C_7, PPTPCPRPQPCPHSSMPSPCLCPCPSGPSRRRGQKHGHRMKRMGRPLRRTWTASRRA CARWCCGRPRTPRSSGTCRGRGSTPATSRS, (SEQIDNO:5745); XM_005629021.1, SLC5A9, Del, C_7, PPTPSQALVQPGCFWPWAGSSSPCTSLPAWSQCHST, (SEQIDNO:5746); XM_005633500.2, NEU3, Del, C_7, PPTPSWPLQRSAPRAGMRMLSTWC, (SEQIDNO:5747); XM_532844.5, SLC25A4, Ins, C_7, PPTPTGPACQQTDQCREAVQRDH, (SEQIDNO:5748); XM_843371.3, LOC606890, Del, C_7, PPTRCSRKSTRWWSSGGRPRAQLPLPPP, (SEQIDNO:5749); XM_014122642.1, FAT3, Ins, C_7, PPVPQRHGFGGPARRL, (SEQIDNO:5751); XM_005639694.1, LOC609445, Ins, C_7, PPVPSEWLVEAPALLPGGGLGHIPHLGCCQLWHLHSLPAT, (SEQIDNO:5752); XM_005626794.2, TMEM8B, Ins, C_7, PPVPVPVPALAPDPSSALVPPPFTNPSPTPVPAPCPVFA, (SEQIDNO:5753); XM_542527.5, IGSF22, Del, C_7, PPVTSLRCGRKTLRSGPSAQRSPSRAPATRWEASPRGRNTSSESGL, (SEQIDNO:5754); XM_532621.6, ARHGEF40, Ins, C_7, PPWEQHSHSGQWRDLRAVPAESCPSPE, (SEQIDNO:5755); XM_005618546.2, LDB2, Del, C_7, PPWGTAALGAVNPPPLRRPNQKAPRPRLPS, (SEQIDNO:5756); XM_005640917.2, SUSD4, Ins, C_7, PQAAGRRPVDPAGAVLRARTAHGRLPRPSDRRCGDP, (SEQIDNO:5757); XM_014122386.1, KIAA1683, Del, C_7, PQAISWHILLPVWQSLGRRGIEPRAPLPVRTAHRSE, (SEQIDNO:5758); XM_014114097.1, KCTD19, Del, C_7, PQALGRGAMQQAWSL, (SEQIDNO:5759); XM_005631410.2, ANKRD13D, Del, C_7, PQALRNSFAWPWSCLRGSRRSRNDGGSRRRKTYRGSCNSRSRST, (SEQIDNO:5760); XM_847571.4, ANKLE1, Del, C_7, PQANGTAAQIRPLSPRLKPLELKTQPWTPPRGLGHYPGPSRDSCLIFNLPRGCQGLQV PHSQCIELPWQTGRQN, (SEQIDNO:5761); XM_014110163.1, MUC13, Del, C_7, PQAPAVLAKELPVKVILPVLA, (SEQIDNO:5762); XM_014107017.1, CHD6, Del, C_7, PQAPPTLKGRCLLLQPPSQPQQPAARPRKPFPARVCLTG, (SEQIDNO:5763); XM_005629454.1, TMEM192, Del, C_7, PQAPREPLLQSPPTAILTGLLTGVPWISPRVLKMTPFWIPTISHIIHYMLILDPDSILFLR SS, (SEQIDNO:5764); XM_005639690.2, NKD2, Del, C_7, PQARTGSPLAAGWRLSSPRTPGEPTRGHLHTPGSPVPNPTPAASAAHTVWTRTQSGE TTTWTWPG, (SEQIDNO:5765); XM_547871.5, DCAF5, Del, C_7, PQASPPIPTLEKTTMITPRSKWMTSPLPLPPPLSAALPRWRFSPTGHLQLPT, (SEQIDNO:5766); XM_014117947.1, KIF12, Del, C_7, PQATLALPSVPEKGVIATGLRPESWRRC, (SEQIDNO:5767); XM_014109614.1, ARID3B, Del, C_7, PQAWAAVPAAAAALTAPRALPRPGAPPAPSRPPAGPS, (SEQIDNO:5768); XM_014121956.1, DOCK3, Del, C_7, PQCLPEACCMVITPYTLTPSTTPWVTPPQPCLPGLCASLLSTLSRPPPPAPSRVWTAAT LHCLAVPAAACPP, (SEQIDNO:5769); XM_014118847.1, ANKRD17, Del, C_7, PQCPLREIPL, (SEQIDNO:5771); XM_014108635.1, ZNF641, Del, C_7, PQCQSAMCALSVGRALADGTTW, (SEQIDNO:5772); XM_014122189.1, HEMK1, Del, C_7, PQCSFLARKLRAESLLWIKEKLPSVLPRRMLRGFGCWTEFGLSPSM, (SEQIDNO:5773); XM_005632499.2, HEMK1, Del, C_7, PQCSFLARKLRSWLSGC, (SEQIDNO:5774); XM_014107603.1, HJURP, Del, C_7, PQDPRLWPCTGVTQRALAAPRP, (SEQIDNO:5775); XM_014114179.1, DTX2, Ins, C_7, PQDRHCLWGPPGLCSIQQALPLWG, (SEQIDNO:5776); XM_544457.2, RAB42, Del, C_7, PQDSSPQVLASV, (SEQIDNO:5777); XM_014121784.1, NBEAL2, Del, C_7, PQDWTPGRLGPRPGTPDTPVPSSARYRAWPGTRAARAPYTTST, (SEQIDNO:5778); XM_005621273.2, FBRS, Del, C_7, PQEPFWGPHLHLCPPPGLVPHLGPLVQPGLTG, (SEQIDNO:5780); XM_014106300.1, FARP1, Del, C_7, PQEPRPPPLKSARAPRRPGAPRAAGRRPEPRGRPPKRRRRTGPPPPPRTGVRRVKLSP RSRAQAP, (SEQIDNO:5781); XM_547000.5, TNRC18, Ins, C_7, PQEREEPQQ, (SEQIDNO:5783); XM_014116626.1, HSF2, Del, C_7, PQESSRGRRYQQTQLLPLVLTQMARVFWFWMNKDLQKKFFLNISSTITWQAL, (SEQIDNO:5784); XM_014111977.1, IGSF1, Del, C_7, PQFGARNCKSGAKDGWQAWSSFCIRRECRNLSSNFMPLGEKPSLQSKEWRIKTKAII AAVLILKSAPSSGLSPVIPWSLS, (SEQIDNO:5785); XM_014120094.1, POU2F2, Ins, C_7, PQFHPLCHSPTPGHHQQHKSQPSRQPLGHRLVGPEPQHGKHNGGVELRAESSPHEQQ PFGHYPSPGLWWNPAPYQP, (SEQIDNO:5786); XM_861140.5, POU2F2, Ins, C_7, PQFHPLCHSPTPGHHQQHKSQPSRQPLGHRLVGPEPQHGPWPLVEPCPLPAL, (SEQIDNO:5787); XM_014120097.1, POU2F2, Ins, C_7, PQFHPLCHSPTPGHHQQHKSQPSRQPLGHRLVGPEPQHGV, (SEQIDNO:5788); XM_547725.4, REM2, Del, C_7, PQGHPRQKQMPHC, (SEQIDNO:5790); XM_014109885.1, PDE5A, Del, C_7, PQGLIMMKGTSARDSWN, (SEQIDNO:5791); XM_014121843.1, APC2, Del, C_7, PQGPQPTPPAAAAMGRRGHCQGWRRRAPRGVASGTRTSHTSCGARCPPPPCH, (SEQIDNO:5792); XM_005629518.1, EZH2, Del, C_7, PQGRRRGNTGCGRHTAERYS, (SEQIDNO:5793); XM_005633132.2, DAZAPC Del, C_7, PQGSLLHLLLQGGQHLWPSLRLRLRPPQT, (SEQIDNO:

5794); XM_014109477.1, STARD9, Del, C_7, PQGSLVAWEVLRNWKL, (SEQIDNO:5795); XM_014110764.1, KCNH7, Del, C_7, PQHPSRRTEVSVLPHNVLNF, (SEQIDNO:5797); XM_005637906.2, TUBGCP2, Del, C_7, PQHQRPGSPSLPS, (SEQIDNO:5798); XM_014118244.1, SYNGAP1, Del, C_7, PQHRPPHPGCRSLRTASSETPQTT, (SEQIDNO:5799); XM_535422.5, FlvLN1, Del, C_7, PQHWHRSACS, (SEQIDNO:5800); XM_014106637.1, DLEC1, Del, C_7, PQIPLPSKFSSLPGAVSCMSPRWWWKVCLARRPAPYGSGAEALMMRDTCHPTSS, (SEQIDNO:5801); XM_846459.4, SMG1, Del, C_7, PQISLLKSSGHLVPHLMNGGESHSLMPGLLQLCLWSDT, (SEQIDNO:5802); XM_005641622.1, SERPINA7, Del, C_7, PQKMPLSIRCHPSMLTLHLTCTGDSLWRPQIGTSSFPL, (SEQIDNO:5803); XM_005616382.1, ZNF541, Del, C_7, PQKRKPVGTPPTPTRGPASLHPLACDLWCPQKPGPPAPSCPTETSCAVL, (SEQIDNO:5804); XM_545710.3, USH2A, Del, C_7, PQKVSEHPSSMQSLPPMQWSTSAPLRSPME, (SEQIDNO:5805); XM_003432782.4, PDE4A, Del, C_7, PQLLAGGDQPEVLP, (SEQIDNO:5806); XM_014113250.1, FOXR1, Ins, C_7, PQLLPPNCTGIKKQFPLWPQRATDLQFHSTTFPLFPDGPGRLEEYRPPQPLLPRQL, (SEQIDNO:5807); XM_005637602.1, HPS1, Del, C_7, PQLMLLRSRSLKTASRHWSLTPQSLPAPEGFSWMPT, (SEQIDNO:5808); XM_005627727.2, PHF10, Del, C_7, PQLPGKWAEGGKTAKRD, (SEQIDNO:5809); XM_014121819.1, CAMSAP3, Del, C_7, PQLPWPPQQPQPLLPGPQWRKRWAPGGGTSLGLSMNAGPS, (SEQIDNO:5810); XM_014110486.1, LOC102156009, Del, C_7, PQLQVNAGPLTARAVAEKDAPH, (SEQIDNO:5811); XM_014106932.1, LOC106557687, Del, C_7, PQLRAQDGGVEGGPRTGRAGRTRLPSSGGRAQHLDSPQHRPGARGRRRSRCQQTRT GARPRPHVPARPPSLGSRERRAAQTNTGPKALAARL, (SEQIDNO:5812); XM_534442.5, PCIF1, Del, C_7, PQLRTSPESDSSQKSSQAAMV, (SEQIDNO:5813); XM_546181.5, ZMIZ1, Ins, C_7, PQLYELHETHSVAQ, (SEQIDNO:5814); XM_003432343.3, LRRN4CL, Ins, C_7, PQLYSPQSRTEEAEAWGHLCRLRGGCKWSWRKQRARGRWGGP, (SEQIDNO:5815); XM_014107816.1, HECTD4, Ins, C_7, PQMAQQVPQTLATSEWRPACS, (SEQIDNO:5816); XM_003433444.3, HIC2, Ins, C_7, PQPAAIHSLRHSGAVSRACGRTQRGPYPPGAPPGQRLR, (SEQIDNO:5817); NM_001205113.1, ALOX5, Del, C_7, PQPCGPHHRRPRVSSPSSRLWTRCQTVAAPAGIWAQYGH, (SEQIDNO:5818); XM_533813.5, DOCK3, Del, C_7, PQPCLPGLCASLLSTLSRPPPPAPSRVWTAATLHCLAVPAAACPP, (SEQIDNO:5819); XM_014107094.1, HSPG2, Ins, C_7, PQPGARLPVTASPGLTS, (SEQIDNO:5820); XM_537364.5, LRP10, Del, C_7, PQPGPLRPDLRSHLLLLPLRP, (SEQIDNO:5821); XM_014121804.1, CACNA1A, Ins, C_7, PQPHCRPSEQKRQPRPTAKKGGREEGGGGRRPWGRRPQAHAPLQLHVYPLYDQPPS PPVPLHPEPALL, (SEQIDNO:5822); XM_014108301.1, CACNA1C, Del, C_7, PQPHPAAEAGPRSLSPPCGWRGLSPTRNSTAASRPSTAAPGLRSPHPVEEVTAPSGEP GRCPSLCPARLGPGAGSSTAVPAASWKRS, (SEQIDNO:5823); XM_005624843.2, KSR1, Del, C-7, PQPHPSCEGTPS, (SEQIDNO:5824); XM_546088.5, DISC1, Del, C_7, PQPLLALRMPLRQALASYGSHLALLGNVEKLKAACHPERLRPLVRAPRRRK, (SEQIDNO:5825); XM_003432681.3, KMT2B, Del, C_7, PQPLLPGLCPRDRCWVCCQW, (SEQIDNO:5826); XM_846736.4, PITPNM1, Del, C_7, PQPPPLGSPGGQAQPPAHLPPLLRLLMAPPVLPALTSRSPASSSLAPRWAWCWLCAK P, (SEQIDNO:5828); XM_546571.4, KIF1C, Del, C_7, PQPQCPLHIPPHTMGSWSHRSPPVPSPRLGLRRPWRGCRRQRRS, (SEQIDNO:5829); XM_542245.5, HEPHL1, Del, C_7, PQPQCPPMKNPARSSSISLARICILGEQKQPWSSSSSLDSSSLSPR, (SEQIDNO:5830); XM_005632690.2, SSBP4, Ins, C_7, PQPQRPHDGASCSASCGPPWLPAPPPWHHGTLPESSGASKHGPDAESDTSTGHGQR WTPELWRWHAAPTQLPRRPRPAHHEHGPWSARPVG, (SEQIDNO:5831); XM_547068.4, TBX6, Del, C_7, PQPQRSFIRSPESA, (SEQIDNO:5832); XM_544699.6, CGNL1, Del, C_7, PQPRIKRRTKSRQPRRR, (SEQIDNO:5833); XM_014106893.1, MAST4, Del, C_7, PQPRSASDVRS, (SEQIDNO:5835); XM_014122378.1, CFD, Del, C_7, PQPRSLVGASWAGARPSPTRGPTWRRCRWTASTCAAASWCRSAGC, (SEQIDNO:5836); XM_538386.5, SH3BP1, Del, C_7, PQPSPLNPGPGALPQRPT, (SEQIDNO:5837); XM_005620701.1, LOC100855981, Del, C_7, PQPTCREWTGARAWPDGLRPGQPSVVPQPKALHQHLEPPSK, (SEQIDNO:5838); XM_005639515.2, LSAMP, Ins, C_7, PQPVAARPAQAALPSPHRTARSQRGL, (SEQIDNO:5840); XM_538715.5, RUSC2, Del, C_7, PQQKMRKEPQSLPLGASSGDISLAPERLSGRPGPQTGSPPTG, (SEQIDNO:5841); XM_014115632.1, RIN3, Del, C_7, PQQLLPRLQRPFLPHPRHLPPTLPPMPQAPQTFQAKHPWQPARGSHGPRQAWAPSGR KR, (SEQIDNO:5842); NM_001003179.1, RRBP1, Del, C_7, PQQSRTLSS, (SEQIDNO:5843); XM_003431676.3, CFB, Del, C_7, PQQTGTVPATLSSL, (SEQIDNO:5844); XM_005638522.1, IGDCC3, Ins, C_7, PQRAGGLCVVHRGPGVLE, (SEQIDNO:5845); XM_014117663.1, AKAP2, Ins, C_7, PQRAPGRPPRGSG, (SEQIDNO:5846); XM_005635245.2, PHACTR3, Del, C_7, PQRAPNIWSQGSALPR, (SEQIDNO:5847); XM_536923.5, LOC479795, Del, C_7, PQRAPQSLSKTRQRMRARTQLC, (SEQIDNO:5848); XM_005624637.2, TMEM92, Del, C_7, PQRGSGRPPLSPHPPMSEIILKPVLPPMEPPPPYSFMP, (SEQIDNO:5849); XM_846500.4, TMEM92, Del, C_7, PQRGSGRPPLSPHPPMSRSF, (SEQIDNO:5850); XM_547143.4, ZNF500, Del, C_7, PQRGSRRPLGQGPAATRRAVRFRGPFWNIEVRVH, (SEQIDNO:5851); XM_003432681.3, KMT2B, Del, C_7, PQRLLPGNGVRRAQNGWCRH, (SEQIDNO:5852); XM_005626050.1, FAM178B, Del, C_7, PQRLPWTLA, (SEQIDNO:5853); XM_541537.5, DHX34, Del, C_7, PQRLRILPPSPSPRRLPCRGPTTARPARRTFCSRPRRCCGTADSTC, (SEQIDNO:5854); XM_005641921.1, LOC100856776, Del, C_7, PQRRGLILQGP, (SEQIDNO:5855); XM_845495.4, DGKZ, Del, C_7, PQRSLMLWRRMGRRVCTRRQPWASAPSATTSWRLGPLS, (SEQIDNO:5856); XM_005632683.2, CRTC1, Del, C_7, PQRTRASRQWGSTLPRRRLCSSTVLVPAPRLTSLPPHLSPIKASPLGAPRNWSSST, (SEQIDNO:5858); XM_005632684.2, CRTC1, Del, C_7, PQRTRASRQWGSTLPRTPPPWAACLGTRTMSSRWRPGRPMLCPTSWSSST, (SEQIDNO:5859); XM_005625714.2, HDAC10, Del, C_7, PQRTRRPCCT, (SEQIDNO:5860); XM_003434181.3, LOC100686305, Del, C_7, PQRWSWIQLWQHSTSTI, (SEQIDNO:5861); XM_549068.5, ZMYM3, Del, C_7, PQRWTTVLRGPLHGMQETRP, (SEQIDNO:5862);

XM_005624295.2, KCNJ16, Del, C_7, PQSEDLTHQTPR-SEEGRLVRLPLSAAVKTPRRPPRLPRMSVRKP-LIRKLS, (SEQIDNO:5864); XM_541627.5, PAK4, Ins, C_7, PQSHEDDSGQPATPTEKPAQGVTIPEGLPGP-PAGA, (SEQIDNO:5865); XM_005630569.1, RAB11FIP5, Del, C_7, PQSLLFHHPLCHPGPATAMGGPAL-HALLCLELGL, (SEQIDNO:5866); XM_005621644.2, ZNF213, Del, C_7, PQSLRRRPLGREQVC, (SEQIDNO:5867); XM_014119601.1, MAP7D1, Del, C_7, PQSPDLLQKGTPPRRRHHHLRCQPWSLTLPQTPLQP, (SEQIDNO:5868); XM_014112559.1, TNIP2, Del, C_7, PQSPRRPPALS, (SEQIDNO:5869); XM_005626612.1, TPD52L3, Del, C_7, PQSPVTPAGSRTLQVWISTL-LAEILSPLATSSTLCTRNWTWTLFM-KIFPSPCRAPRQRL QRAPLNPARLPKQRISQGL-HERSSNPCSLNWRRKL, (SEQIDNO:5870); XM_014106895.1, LOC100683453, Del, C-7, PQSRPG-GAHPRAAPTAHGPQP-WARTVPGTRGSQKPLGQWRPD, (SEQIDNO:5871); XM_014118242.1, SBK3, Del, C_7, PQSSAS-CCHLIPCPCDQLWTPGAWGCFSSALPLLVSLGM, (SEQIDNO:5872); XM_846556.4, CHRDL2, Del, C_7, PQS-TASTMGPCTNTERSSVPMSCSLPACPTSVSSAAVLR-ARSTAVS, (SEQIDNO:5873); XM_845641.5, EPN1, Ins, C_7, PQSWGIRHEWGRGLSG, (SEQIDNO:5874); XM_534785.5, ZNF385A, Del, C_7, PQTGMVQRPVQFPWRMDWVQPRDPQRNSLAPHLL-PAFRRLVKVQPRVKAGLQPQL PCR-GAARKKRKRPSGCSTVLCARWQ, (SEQIDNO:5875); XM_014116465.1, NOS2, Del, C_7, PQTSFYLKPLNLST-SITAPSKRQK, (SEQIDNO:5878); XM_005637736.2, TCF7L2, Del, C_7, PQTSLSALKSSGT, (SEQIDNO:5879); XM_014115361.1, ADAM15, Del, C_7, PQTSPGSRTSS-CQATPVP, (SEQIDNO:5880); XM_548160.4, GPR179, Del, C_7, PQTVSAVTYLKLALRDWLRCARGMLPHL-TAAPKRRSAPGR, (SEQIDNO:5881); XM_014120407.1, FAHD2A, Del, C_7, PQVLVYSGNLQFFSR-RAMKFNVKSKN, (SEQIDNO:5882); XM_543487.4, PLA2G3, Del, C_7, PQVPASRAQPPASLDRSSVL, (SEQIDNO:5883); XM_014117075.1, DENND1A, Del, C_7, PQVRRRSRGTSPVLPLKHPPNCCNH-SAWPPGLQAQAAMPCWPSWTLFTQRGQAVLF PQALQPQM, (SEQIDNO:5884); XM_005636541.2, ZDHHC8, Del, C_7, PQVSLTGSPRAWPAWGLPL-APRGPPPALPGTRSLRRCPAWVGPRTRSQC, (SEQIDNO:5885); XM_003432698.3, ZNF784, Del, C_7, PQVTSSRSR, (SEQIDNO:5886); XM_005623502.2, PLEKHG3, Del, C_7, PQVTWGTLWWWRAPRILRL, (SEQIDNO:5887); XM_548107.3, KRT36, Del, C_7, PQWISTRSWMI, (SEQIDNO:5888); XM_014121835.1, JSRP1, Del, C_7, PQWPPARPPPLCSPPAE-PIGPRRCPRPPVAARPGR-SPSSDCQVPAAVRHPPSSDPQLRS PAPIWAPPSP, (SEQIDNO:5889); XM_003639660.3, B4GALNT4, Del, C_7, PRAAAASRRPRPPPRRAPGAPGR, (SEQIDNO:5892); XM_014106893.1, MAST4, Del, C_7, PRAAGPLRRRP-PRGSLPPPASG, (SEQIDNO:5893); NM_001003009.2, TPO, Ins, C_7, PRAAGQDPGRGPHIQ, (SEQIDNO:5894); XM_014107093.1, PTPRT, Ins, C_7, PRAAGRRGHIPVDQAKCQLNHRGWPHHPEGG-GISHHYRHLG, (SEQIDNO:5895); XM_005634029.2, MBNL2, Del, C_7, PRAARWRTEESLPASIPSRAVVQERT-TASIFILQHI, (SEQIDNO:5896); XM_014117212.1, TBC1D30, Del, C_7, PRAATRKRPSLALSPASNH-CASQPLPGIWGYMVLRKEPQPCTFPT, (SEQIDNO:5897); XM_005630569.1, RAB11FIP5, Ins, C_7, PRACF-STTPSATLGQPLPWGAQPSMLSSAWSSASDFFLPNPW-GASLLPWGLPCPTWG GPRCNYPSLPACASALGDTTS, (SEQIDNO:5898); XM_545640.4, RUFY4, Del, C_7, PRACGNQRGRG-FREPQEQDSAWRTQHPASRDKGSGPRELRRR, (SEQIDNO:5899); XM_014115705.1, CCDC88C, Del, C_7, PRACPWADPGRPPCPRRPTRPPAGP, (SEQIDNO:5900); XM_541492.5, PRR12, Del, C_7, PRACRPQCQP-GACSRSLLPPPLCHTRLLLEPLGWEVRWRRLRAR-GLGWAALRPASG WMRS, (SEQIDNO:5901); XM_005626825.1, GRHPR, Del, C_7, PRAGPR-SPGLRTVRWSSGIQTSQSLPRSWSEVWPGPTASSAS-SRTMWTRGSWTPQEP ISKSSAQCP-WALTIWLWRRSRSAASVWATPQMS, (SEQIDNO:5903); XM_014110256.1, TNK2, Ins, C_7, PRAHPPEAHPPTGRAVSSPLRRGGDRAVAWTRLPSP-GASPGAPVPSRLTOP, (SEQIDNO:5904); XM_005616882.2, AXL, Del, C_7, PRAH-RLRQTPLWGVQGTSPVPEDSPGPFGVSSRFRGSPLR, (SEQIDNO:5905); XM_014118242.1, SBK3, Ins, C_7, PRALPPAAT, (SEQIDNO:5906); XM_005616884.2, MAP3K10, Del, C_7, PRAPASSPG, (SEQIDNO:5907); XM_014110537.1, LOC106558245, Del, C_7, PRAPFSSQHPHGVSFPFSSSFGYSVPWSA, (SEQIDNO:5908); XM_014116397.1, LOC106559250, Del, C_7, PRAPPKPPPAPTRAASPGSWSCWASRT-CPRCGRCSPRSSWPCSCSRCWATRSSCC, (SEQIDNO:5910); XM_005616836.2, LOC102154596, Del, C_7, PRAPPKPPPAPTRAASPVSWSCWASRT-CPRCGRCSPRSSWPCSCSRCWATRSSCC, (SEQIDNO:5911); XM_854614.4, MBD6, Del, C_7, PRAPPQPWSRSLPGLPSVP, (SEQIDNO:5912); XM_548855.5, WWC3, Del, C_7, PRAPPWTRLSFRP-PATRP, (SEQIDNO:5913); XM_005626260.1, ATP6V1B1, Ins, C_7, PRAPQSRGGIANAFVG, (SEQIDNO:5914); XM_846015.3, HOXB2, Del, C_7, PRAPRPRPLPG-GAPRARPRGWSPSRCRKMPSRSARILLSCPTST-SSRSTPVSSCPEASPP ACRARSTARFPF-PRKSWTSSPAPSVPSTCSSL, (SEQIDNO:5915); XM_014116191.1, UNK, Del, C_7, PRAPSGSPQTWKALSSLGSLASPLAAIRRLLA-LRGKTRWELST, (SEQIDNO:5916); XM_014121820.1, LOC106560103, Ins, C_7, PRAPSRPLRAPER-AGRFCRVSRRRAGRWAGSRRLL, (SEQIDNO:5917); XM_014119601.1, MAP7D1, Ins, C_7, PRAQTFSRRGPL-PAAATTTSDVSPGP, (SEQIDNO:5918); XM_014112559.1, TNIP2, Ins, C_7, PRAREDLLP, (SEQIDNO:5919); XM_003432681.3, KMT2B, Ins, C_7, PRARGAGLPPTAAQVSPALRQTATLL, (SEQIDNO:5920); XM_533913.5, RAB3D, Del, C_7, PRARGMQQTRTLTTCLSCCSSATAAWARRP-SCSATRMTPSHLPSLALWASTSRSRRS IVMTRGSS CRSGTRRARSATVQSPPPTTAEPWASC, (SEQIDNO:5921); XM_546631.5, HS3ST3A1, Del, C_7, PRAR-PAPPPPPSRCPAASSGGSC, (SEQIDNO:5922); XM_014112163.1, LOC100856005, Del, C_7, PRAR-PAWSPRGPRRALRRVLTQRALSLETKGTLGGQD, (SEQIDNO:5923); XM_014112161.1, LOC100856005, Del, C_7, PRARPAWSPRGPRRALRRVLTQRGCRGVWGAR-RACG, (SEQIDNO:5925); XM_014109523.1, PML, Del, C_7, PRASELSACRP, (SEQIDNO:5926); XM_541535.6, SLC8A2, Del, C_7, PRASSWTARSWAPRCRAS-WAAWARAPPRPASWTPAAARSSRSSRTSSRSTR-TRTWS SWWASPT TTRCCTSRRAAPSTASRPRGS, (SEQIDNO:5927); XM_541885.4, BSN, Del, C_7, PRATCHPLRMPPQLRS, (SEQIDNO:5928); XM_014114192.1, ZNF853, Del, C_7, PRATWCCRSS-WCCLPWPRPRWWPFPAPRAARL, (SEQIDNO:5929);

XM_005616509.2, DMRTC2, Del, C_7, PRAWSLSPREL-SAALQPVPAAETTESLPTSRATSACASFR-LASVTNVSSSWSAEGSWL PRWPCVGNRRHSSRDIWLRA, (SEQIDNO:5931); XM_014118394.1, LOC484306, Ins, C_7, PRCDLRSAE-PLDPQTEDKCILSLPVRGAPSRAQCVCCSGHSL, (SEQIDNO:5932); XM_014118423.1, LOC611446, Ins, C_7, PRCDLRSAEPLDPQTEDKCILSLPVR-GAPSRAQRVCCSGHSL, (SEQIDNO:5933); XM_005635182.1, NFATC2, Del, C_7, PRCGRRAP-TRRPCLPPRPRPACPATSTRPWSSWGPASRRRAG-ARPPSPSCSCRPPGSS WCQLFPSAASQ, (SEQIDNO:5934); XM_847906.4, PGLYRP2, Ins, C_7, PRCHLCRCWSHISKY, (SEQIDNO:5935); XM_005616406.2, ZC3H4, Del, C_7, PRCLCQCMSHCPRSSCSSSRTCTPVRSPPCLRS, (SEQIDNO:5936); XM_014120347.1, ASAP2, Del, C_7, PRCPHGMLPKIPWLPHRPLQ, (SEQIDNO:5938); NM_001131049.1, DNM1, Del, C_7, PRCPRAPTAPRPGSPADRVRQVRPVLRAPGPPSTS, (SEQIDNO:5939); XM_014117260.1, PPP6R2, Del, C_7, PRCPRQPPGSSPRPPRLRKPPTPQLWPRPPRPPPLPW-PAPPG, (SEQIDNO:5940); XM_848382.3, EBNA1BP2, Del, C_7, PRCRVRTRNLRILWSRTESCRMRFPEAS, (SEQIDNO:5941); XM_014117000.1, HMCN2, Del, C_7, PRCSQARGS, (SEQIDNO:5942); XM_005638641.2, CSPG4, Del, C_7, PRCSRSPGPT-SLHCPASNCGSSSSPCTGPCGERRPLKRGPSAL-SPGKR, (SEQIDNO:5943); XM_014120407.1, FAHD2A, Ins, C_7, PRCWCIQETSSFSQEGR, (SEQIDNO:5944); XM_846534.4, PRCC, Del, C_7, PRCWPPPSPRHCCCPRPPGTPGSSPRRPCRSAWEA-SLPLRASARRRRRELGRGWGCP RPGAPASACPPP-WAVPGPPWAFPSQRRGRSP, (SEQIDNO:5945); XM_014109686.1, SYNJ1, Del, C_7, PRDHLHLQGLGVLHLLEKNSEHPKALEQHGKIL, (SEQIDNO:5946); XM_014109687.1, SYNJ1, Del, C_7, PRDHLHLQGLGVLHLLEKNSEVLEPLPVLGQLGER-WKHPKALEQHGKIL, (SEQIDNO:5947); XM_014109683.1, SYNJ1, Del, C_7, PRDHLHLQHPKA-LEQHGKIL, (SEQIDNO:5948); XM_014109643.1, C30H15orf39, Del, C_7, PRDSRPVPR-SAGLFCRVTARCHPARHPCLSSTMSSAWPRTATTWM-CRPPRTPLSPPR RQPPAGALQRTVGRPWPPGRCPQSP-CAPAERR, (SEQIDNO:5949); XM_014121829.1, TMIGD2, Del, C_7, PRDVAPSPRACEASF, (SEQIDNO:5951); XM_846500.4, TMEM92, Ins, C_7, PREGQDVHL, (SEQIDNO:5952); NM_001130437.2, PABPN1, Del, C_7, PRELRALGLAREPPAARRRRRSRDWSRVTRGTAPLR-TRSWKRSKLESGRWRKKLRS, (SEQIDNO:5953); XM_005632684.2, CRTC1, Ins, C_7, PREPGPAANGDRHYLALLHLGQRVWGLVL, (SEQIDNO:5954); XM_005632682.2, CRTC1, Ins, C_7, PREPGPAANGDRHYLGAGSAAVPC, (SEQIDNO:5955); XM_014120095.1, LOC102155747, Del, C_7, PRESGSGVGGGARSRRPRPLWDPN, (SEQIDNO:5957); XM_005635260.2, OSBPL2, Ins, C_7, PREWDSETQD-VIARPDVYQK, (SEQIDNO:5958); XM_005622972.2, ADCK3, Ins, C_7, PRFLCSHLP, (SEQIDNO:5959); XM_005641877.2, GPR101, Del, C_7, PRFMVGARLPST-SAMPSAP, (SEQIDNO:5960); XM_005623032.2, EMILIN2, Del, C_7, PRFPRTPGN-GRTQASGLSCPRDPRSRCPRQRGRAGQGCPSCPAPPGS, (SEQIDNO:5961); XM_843145.5, PDIA4, Del, C_7, PRFPWLRWMPLRKQTWPRGSRSLAIPR, (SEQIDNO:5962); XM_005629401.2, LOC100855618, Del, C_7, PRGARAAPTWS, (SEQIDNO:5963); XM_014118248.1, LOC106559564, Del, C_7, PRGARLGRARRLRREPA-GANSSGSARGSRA, (SEQIDNO:5964); NM_001003016.2, MCLI, Del, C_7, PRGCCCSRP-PAARRRLKRWKARPPTPSCRPKRS, (SEQIDNO:5965); XM_847216.3, RD3, Del, C_7, PRGCPPG-GRLRWCWRRS, (SEQIDNO:5966); XM_014113861.1, ZNF469, Del, C_7, PRGGAMHRPYHSR-PAGQTAAPSSSTL, (SEQIDNO:5967); XM_014115768.1, SYNJ2, Del, C_7, PRGGGRNRHPQPSTCRCCRA-TASSSRPSPAAPQAATGPLHTCPTRVHLCRHLPASVL PLPQAPKLRAPGRPRQRQPPFWVTIRIPSGAFSITLAF, (SEQIDNO:5968); XM_003434181.3, LOC100686305, Ins, C_7, PRGGHGSSSGSTVPARSRGCSDDRAPGWG, (SEQIDNO:5969); NM_001194984.1, RAN, Ins, C_7, PRGGHGSSSGSTVRARSRGCSDDRAPG, (SEQIDNO:5970); XM_543631.5, CALCOCO1, Del, C_7, PRGGSALFVRSASQPRVIRTPWRTTWMDTSFSAP-RTPLPLS, (SEQIDNO:5971); XM_005641921.1, LOC100856776, Ins, C_7, PRGGVCCSRGPK, (SEQIDNO:5972); XM_005625714.2, HDAC10, Ins, C_7, PRGHAGPAVLERAAGSTVEDAAGGRSFL, (SEQIDNO:5973); XM_014107007.1, DIDO1, Del, C_7, PRGLPHRH-PRCRSHPVRLRHRHRQC, (SEQIDNO:5975); XM_014112439.1, FURIN, Del, C_7, PRGNASLTSSLN-PRTSGSGWRCGRL, (SEQIDNO:5976); XM_539768.4, FHDC1, Del, C_7, PRGPGRPGTAPPSA, (SEQIDNO:5977); XM_014113173.1, DRD2, Del, C_7, PRGPGTVPYHPATTS, (SEQIDNO:5978); XM_536750.5, CDH15, Ins, C_7, PRGPLPLSAESPSPRAYPELEPQPD, (SEQIDNO:5979); XM_014109945.1, WDFY3, Del, C_7, PRGPQVTRSFSITWTT, (SEQIDNO:5980); XM_014122137.1, CPAMD8, Ins, C_7, PRGPR-GAGQGPAQHLQLHGHL-CRGVREDLCSQGHPVCRAPRQTPSDQEDVRGLWG DGACLGGSLLQ, (SEQIDNO:5981); XM_005633132.2, DAZAP1, Ins, C_7, PRGPSSTCYSRGSTSGLPSASVS-GRPRHEQASNGPARLPL, (SEQIDNO:5982); XM_014118655.1, ZC3H3, Ins, C_7, PRGQTSSRIQQFEAPLQ, (SEQIDNO:5983); XM_014111971.1, DUSP9, Del, C_7, PRGRGCCSSTAGAASCTSRRASAGR, (SEQIDNO:5984); XM_005637802.2, TACC2, Del, C_7, PRGRKLLSGP, (SEQIDNO:5985); XM_544644.5, TTBK2, Del, C_7, PRGRVSQPLNSAD, (SEQIDNO:5986); NM_001289434.1, SLC4A3, Del, C_7, PRGRWRLGWS, (SEQIDNO:5987); XM_014122484.1, CCDC34, Del, C_7, PRGSHSTAAAPPCVGRAAR, (SEQIDNO:5989); XM_005636540.2, ZDHHC8, Ins, C_7, PRGYVPPALSRLQPFPRSLGA, (SEQIDNO:5990); XM_014113085.1, SAL13, Del, C_7, PRHAGHPSSTTASHVGRPSPRPAPSRFTSVHTPGRSP-SAAPSAGGHSPQRATSRCIWA RTCGIMPPRGVAAACPWKTPWLC, (SEQIDNO:5991); XM_005632766.2, WIZ, Del, C_7, PRHHWSSLLATSTPS-SAGSVRWNSRGPSLSRRSGCGTYSGTSWR, (SEQIDNO:5993); XM_005617639.1, LCK, Ins, C_7, PRHQADYQQTLGHGSPNCRGHGIH, (SEQIDNO:5994); XM_854174.4, BAG6, Del, C_7, PRHQLWPRSR, (SEQIDNO:5995); XM_005638000.2, PLAG1, Del, C_7, PRHRIFRILQTP, (SEQIDNO:5996); NM_001048101.2, TAPBP, Del, C_7, PRHTASSAASSRCPPRRGGPVA, (SEQIDNO:5997); XM_005640837.2, MIA3, Del, C_7, PRK-AGVARWKGCSHTLKIISHKVTPKIISHKTT, (SEQIDNO:5999); XM_005619439.2, LRIT1, Ins, C_7, PRKALGARAARNLGSEA-WCPGGWGVQQPLLPCGPQAAELSWPCIPCRRAEL-WAE, (SEQIDNO:6000); XM_545954.4, KLF3, Del, C_7, PRKHCCKRIIHQS, (SEQIDNO:6001); XM_014114300.1, DAGLB, Del, C_7, PRKLIWTQS, (SEQIDNO:6002); XM_005631964.2, ZEB2, Del, C_7, PRKTLYYPGRP, (SEQIDNO:6003); XM_847455.4, CHRNB4, Del, C_7, PRLASRSPAGPRPPPPSPMGAPCTL, (SEQIDNO:6004); XM_546499.4, PHLDB1, Del, C_7, PRLCPPKLPGSCRFTAPRWMVRPPAPCPGPAVAPSPPPLVLLPLLRSSAWLLWAGAP PQRVPYLPRMAQAAFLATWRPRCRTLRPSASWPCSRRDSR, (SEQIDNO:6006); XM_547482.5, DUSP27, Del, C_7, PRLEVPRDGRPLARVRRSQKTKRTWRG, (SEQIDNO:6007); XM_539698.4, PTPRQ, Ins, C_7, PRLFCKTVVWCHGEVVMATTPGAKWNYPLLHSLCLG, (SEQIDNO:6008); XM_543973.5, SEMA4G, Del, C_7, PRLHHPHPHRLS, (SEQIDNO:6009); XM_014113210.1, LOC106558749, Del, C_7, PRLHLGRWGANAGPGALGG, (SEQIDNO:6010); XM_005620748.2, ATXNL1, Del, C_7, PRLHPQPTHSTKLLPLPHLGSCHITQVLSHWTLLQAGCPFIIRCPGYLLGTLCMKPLQ QVPAQFLPLRRASLLWKQPLPTDRDSENEI, (SEQIDNO:6011); XM_014113861.1, ZNF469, Del, C_7, PRLKGTAGSTQKSLCPALESSLSLHWT, (SEQIDNO:6012); XM_005624978.1, LRRC3C, Ins, C_7, PRLLHGRRSW, (SEQIDNO:6013); XM_005620601.1, GPR157, Del, C_7, PRLLHPPRQETLRDPDVPQMNFQAP, (SEQIDNO:6014); XM_014114423.1, POLR3E, Del, C_7, PRLLHPQMSRRCSPSGSLET, (SEQIDNO:6015); XM_005615776.2, CEACAM1, Ins, C_7, PRLLLPSRGKPQSLLPHSF, (SEQIDNO:6016); XM_848182.3, C3H4orf48, Del, C_7, PRLPAGSRGRCRRGCCCC, (SEQIDNO:6018); XM_005642274.1, LOC102152225, Del, C_7, PRLPASPDRTVAGAPRVPRP, (SEQIDNO:6020); XM_003639335.2, LMF2, Ins, C_7, PRLPCGQGGEAQASP, (SEQIDNO:6021); XM_005629454.1, TMEM192, Ins, C_7, PRLPENPSCRAPPPRS, (SEQIDNO:6022); XM_014119273.1, LOC106559736, Ins, C_7, PRLPGRQPRLHTPEPEPEPEPEPEPEPAAGGQGGGYLGPGLVSRSALRRRRGRAGASV SSRAAGRGTPDV, (SEQIDNO:6023); XM_014122252.1, ABCA7, Del, C_7, PRLPLRGTQRCSQRRCRRA, (SEQIDNO:6024); XM_548528.6, RGS19, Del, C_7, PRLPPAATPAACAGVAVAAAPGTRSGGVRGGPPGTTSCSPCPAVRRAPRQAPRRCG AGRSRSTS, (SEQIDNO:6025); XM_003433540.4, P3H3, Del, C_7, PRLPTCSTPTVCAPTRPGLGRRPWRCCGRRCGAGRRWAARAGTAGRSARRSRGPRS PRCRSTPRGGTRGPAGRRGPGSACCSALRSAGPSA, (SEQIDNO:6026); XM_535500.5, MYO1E, Del, C_7, PRLQDTIRMESSKTSLCHILMLLETRG, (SEQIDNO:6027); XM_005636226.2, HVCN1, Ins, C_7, PRLQGHIKEALQLPQVSGYHHLPGHSGCPPGAGRAHSGPEDHPG, (SEQIDNO:6028); XM_014116431.1, ILL1, Del, C_7, PRLQPGEASGQPMPFLGGCT, (SEQIDNO:6030); XM_014111656.1, HDAC6, Ins, C_7, PRLQRHLEARC, (SEQIDNO:6031); XM_014117415.1, SHANK3, Del, C_7, PRLRRHPHQPPTTSTRGRPPPSRLRRPRAAPTTLCAPALSPAWRRAWARGPQACMRP GRPWGRCPTPSGRSARAP, (SEQIDNO:6032); XM_005621660.2, KREMEN2, Del, C_7, PRLSAAPAAPRQSSRCRCASASAA, (SEQIDNO:6033); NM_001003291.1, ICAM1, Del, C_7, PRLWKWAHSGLWTALWMGCSQLRRPKSTWR, (SEQIDNO:6034); XM_845262.3, ITGA10, Del, C_7, PRMLGLALPWVPFLI, (SEQIDNO:6035); XM_005620448.2, CHD5, Del, C_7, PRMPSTPTGWCGTSEGRARRSLEPMCPSSCGTCVSRGLMAQRPSRTVCPGRASRGST CSPASGSCH, (SEQIDNO:6036); XM_014107852.1, EP400, Del, C_7, PRMTITSMWIRSCVSRMRALPSQSPSCLPCT, (SEQIDNO:6037); XM_005616594.2, PLEKHG2, Del, C_7, PRNLWAFAGPRELLMPLSTR, (SEQIDNO:6038); XM_543867.5, PRMT8, Del, C_7, PRNPLNPSSQPSLCNVSIMCPLNPAAQDGVRCPSC, (SEQIDNO:6040); XM_014108968.1, PDZD7, Ins, C_7, PRNPSLLAHGPRHPHQLPHRSQQ, (SEQIDNO:6042); XM_005615881.2, LOC102155525, Del, C_7, PRPAAGLRRLPVTPATPFLPMQIPHGPPRPYPA, (SEQIDNO:6043); XM_005628616.2, RAPGEF5, Del, C_7, PRPAAPRVIGDTWSCPGPRRRFWSTF, (SEQIDNO:6044); XM_543274.5, IRS1, Del, C_7, PRPAARRS, (SEQIDNO:6045); XM_547886.5, ITC9, Del, C_7, PRPAASRRSRARRWKPSRSTATTAWQRACSRLSW, (SEQIDNO:6046); XM_014116613.1, SRCIN1, Del, C_7, PRPAASRSPPCWHPRTWGPLGAQPRAPHGRAVVAACHP, (SEQIDNO:6047); XM_014116610.1, SRCIN1, Del, C_7, PRPAASRSPPCWHPRTWGPLGAQPRAPHGRLPQAPGPSASPRSS, (SEQIDNO:6048); XM_005631406.2, SSH3, Del, C_7, PRPAATPRPWGPRRARHPSGEAGSSEGRALQCSVGLSWDCRMEKTMEKQLRPARR QWRDPWVKNSPTGTRQMMGKGSRVPGSRSRVSICISWWSS, (SEQIDNO:6050); XM_860394.4, DLGAP4, Del, C_7, PRPALAASATVARFQVHHA, (SEQIDNO:6051); NM_001081710.2, SSPO, Del, C_7, PRPALCLALPLALGRLSKLPWPVPAPRRPAVPLSSRAAAANARPGAGSATARRRTART AATSTAAAGPACPPHSCVTASRTARMAQTRALTPARG, (SEQIDNO:6052); XM_005635182.1, NFATC2, Del, C_7, PRPALPSSWTP, (SEQIDNO:6053); XM_533664.5, LTBP4, Del, C_7, PRPAPMAGVRTQKVASSASAPQASNPTRLAPSARMWMSVRITWHVLGRSV, (SEQIDNO:6054); XM_014116237.1, BAHCC1, Del, C_7, PRPARPQPLACPPRRITAPKPRRPRGRSPRAKTKPARRSS, (SEQIDNO:6056); XM_014119948.1, PKDLL1, Del, C_7, PRPARRALSPGPLVARATCWAPW, (SEQIDNO:6058); XM_005625727.2, TILLS, Del, C_7, PRPASCAGAHCRPAGPASAAAPSAPRCCRAPASWPWEAAGAAARGTR, (SEQIDNO:6059); XM_014110586.1, RREB1, Del, C_7, PRPATTWPSPGAGRRAWPSPPRIPAAGRSGRRFGRRALARLKLAGALPRPRRRAAPR SRGLRATRARRARRPSCKICPPVPCWPRTGPRRSWEWS, (SEQIDNO:6060); XM_014106264.1, LOC106557546, Del, C_7, PRPFPLRLRPTGYCALGTAERRGR, (SEQIDNO:6062); XM_014116616.1, TBKBP1, Del, C_7, PRPGCRPRPPRCPSRGPTASSTGPAGRSARGAGPSRASGCASRSSRRRRRSGPCPPARP APRRAPSAAPPSARASPSPRRRPPPTPTPSTRSPGRPSTC, (SEQIDNO:6064); XM_542508.5, GALNT18, Del, C_7, PRPGGSWRTPPPRSGALPSSAALSWIGSTSRRLAY, (SEQIDNO:6065); XM_014116627.1, TMEM145, Ins, C_7, PRPGQVRAGQPQLQRGLGVPDEVLLSFGLRPTGLPFPIP, (SEQIDNO:6066); XM_547204.4, LMF1, Del, C_7, PRPGSFCGASGG, (SEQIDNO:6067); XM_014113546.1, DNAH2, Del, C_7, PRPLASTPMRMWPPRSPRPELCLRLCCPCNPRLHPPG, (SEQIDNO:6069); XM_014108893.1, DOCK1, Del, C_7, PRPLLLTRGMFRLHCPARPHLRLLRRRRASRRQWTPESCS, (SEQIDNO:6070); XM_849158.3, ARHGEF18, Ins, C_7, PRPLLPSPT, (SEQIDNO:6071); XM_014115719.1, KIF26A, Del, C_7, PRPLPCASPAWNTRAARLPPR- PRPGA, (SEQIDNO:6072); XM_003639997.2, CALHM3, Ins, C_7, PRPLPLRPPRQPAVGGDG, (SEQIDNO:6073); XM_540094.2, MSGN1, Del, C_7, PRPLPRGCRVGWEAPRARGAGAGAAGCRWPTRCWPSRPPTCRALLAPRPRRAPRSG CRCSGDARPARGRSSG, (SEQIDNO:6074); XM_014121412.1, NCKAP5, Del, C_7, PRPLQTGQAPFSSSLVMTTCHHPHRPSPKPESPVKQQGPSSNPP1, (SEQIDNO:6075); XM_546308.5, PPARGC1B, Del, C_7, PRPLSQPPSPAAAPPSRSNPGPGPNTLPKAPGPSSPS, (SEQIDNO:6076); XM_847571.4, ANKLE1, Ins, C_7, PRPMGLQLRYVLCHRD, (SEQIDNO:6077); XM_005621273.2, FBRS, Ins, C_7, PRPMGPPAPQSSGLSCLGPAP, (SEQIDNO:6078); XM_014116841.1, DPH1, Del, C_7, PRPPGGPSWRRRSPRATLQSRLATVATAETKRERRGLS, (SEQIDNO:6079); XM_014121831.1, TLE6, Del, C_7, PRPPPAPPAPPRAPRKGAQSRAPELRACSPAWPRSLLGEPVHS, (SEQIDNO:6080); XM_003640189.3, FZD5, Del, C_7, PRPPPPPPTTSRCPCRTC, (SEQIDNO:6081); XM_845849.4, BTBDL1, Del, C_7, PRPPPPPPTTTTTTTTRSTRRPGSPWRRWSTRSTTTPKSGGSCSPTSTSSAGRTPAECC ACQTA, (SEQIDNO:6082); XM_014122215.1, LOC484907, Del, C_7, PRPPPSLTLGMRNTSCPPPRS, (SEQIDNO:6083); XM_014110917.1, LOC106558305, Del, C_7, PRPPPVVPPDRA, (SEQIDNO:6084); XM_014121804.1, CACNA1A, Del, C_7, PRPPRTALSSPTPAAPRPTQRRLPGNPTTPQWTSPQPARPPSTTLSSK, (SEQIDNO:6085); XM_014121783.1, PTPN23, Del, C_7, PRPQAPLLWSWPLVLLSTLPLPTLQSWDLCPGRPHSTVW, (SEQIDNO:6086); XM_014110163.1, MUC13, Ins, C_7, PRPQQSLPRSSL, (SEQIDNO:6088); XM_014117950.1, AKNA, Del, C_7, PRPRATAGSLRALPGL, (SEQIDNO:6089); XM_014115697.1, LOC102152805, Del, C_7, PRPREIGCVGRSRQAAAHGALRTAAGSIPGAGLDVQT, (SEQIDNO:6090); XM_014107737.1, ATXN2, Del, C_7, PRPRHPAPPRSAPARPRRAPASPRRARLPAVPARRAGRCMGPSPCR, (SEQIDNO:6093); XM_014109867.1, LOC611835, Del, C_7, PRPRPFAGLPSLARLGPRPRPVGSLERSRVPQPWTHPRSTLRVAFPPATPHSSWAPRL ASSAA, (SEQIDNO:6094); XM_014111713.1, ATP2B3, Del, C_7, PRPRPPTRTTTP, (SEQIDNO:6096); XM_014116941.1, LOC491253, Del, C_7, PRPRQLQTVTGCLQGLCGEWTRLWPAAGLTLGASWQRATAPWAKETRSLTPAPCR QRRRPGL, (SEQIDNO:6097); XM_014122283.1, ZSWIM4, Del, C_7, PRPSGAGAAPRDRRSAMPGPGPCAAGAGPRRCWTSAPSE, (SEQIDNO:6098); XM_014114212.1, LRCH4, Del, C_7, PRPSGPLLVWGASFFS, (SEQIDNO:6099); XM_014119269.1, LOC106559733, Del, C_7, PRPSGVSMEVALTAQAEN, (SEQIDNO:6100); XM_014106893.1, MAST4, Del, C_7, PRPSHPGPAA, (SEQIDNO:6101); XM_857738.4, SPAST, Del, C_7, PRPSLRISGTCTTSPTRCS, (SEQIDNO:6102); XM_005618689.2, GAK, Del, C_7, PRPSRPPRPVRSQGLTMLPT, (SEQIDNO:6104); XM_014119710.1, PPP1R13L, Del, C_7, PRPSTSWAAPLPRAAAPWPRGPRPSSPSAGPRHAPRPPPTTHPWPSGAPYWARAAAL SPRLCALKTT, (SEQIDNO:6105); XM_014110547.1, GABBR1, Del, C_7, PRPTRPWSSRHFASCHRSSSFQSLSSPAWALSWLWSVCPLTSTTLMSVTSRTPSPT, (SEQIDNO:6106); XM_845370.4, ZNF750, Del, C_7, PRPTTITGSSSSTIPTCPFHTGFTDQSLRSPPTVSDSRPSQVFPEIKAHTSWKKLPCSTRP, (SEQIDNO:6107); XM_861784.4, SERTAD1, Del, C_7, PRPWPPVPSWTFLCSSSTTACGRVSRTCGTWYW, (SEQIDNO:6108); XM_005637883.2, NANOS1, Del, C_7, PRPWRSCPAPAT, (SEQIDNO:6109); XM_544498.4, MYOM3, Del, C_7, PRPWRSTGWNTGRRRSTRKSGSTACRWVPRCGGGPSAAARKSISSAPQTTPWQQPW L, (SEQIDNO:6110); XM_005628400.2, AHCYL2, Del, C_7, PRQAAGTLRLQLPPRSGPRPLARALGPPPLSALPPGKCLRRRP, (SEQIDNO:6111); XM_014114982.1, BCAN, Ins, C_7, PRQADVGGGTGVLPGTGCRDCHHGPALCSLGRGPGPLQPGLAGRWQCALSHCHTQ PALRWGPAWCQDALPLPQPDRLSQQAQPLQRVLLPRLCPALRHA, (SEQIDNO:6112); XM_005625909.1, CSF2RB, Del, C_7, PRQAGARSRSLRGPWSTCVCRREGRYSWSRWPR, (SEQIDNO:6113); XM_014108804.1, SORBS1, Del, C_7, PRQARSQTSPASPVRTRPPLGGSPRFPNACLPDTPWRG, (SEQIDNO:6114); XM_850107.5, R3HDM4, Del, C_7, PRQHPASSQRPAAMRPTWRSGMTS, (SEQIDNO:6115); XM_014117947.1, KIF12, Ins, C_7, PRQPWLCQVSQRKES, (SEQIDNO:6117); XM_003639781.3, DCAF15, Del, C_7, PRQRHQLQSLVMSTTPSCITCWGPAKGQNRRTSSRMTRSPCPLW, (SEQIDNO:6118); XM_005625539.2, INHBE, Del, C_7, PRQRWPEPSADYSPEACL, (SEQIDNO:6119); XM_005624061.1, UBALD2, Del, C_7, PRQTLAPSGPRPHPATRLPGSRPPPPRPTVSTTSTTRSPRGPPGRSRGARSRRPWLPW MARD, (SEQIDNO:6120); XM_854849.4, SGK1, Del, C_7, PRQVLLSKSTWDHHPILMLNHLTFTS, (SEQIDNO:6121); XM_014108691.1, PCED1B, Ins, C_7, PRQVLPPAAHAPAAPALSSPPAQAAVPVRSPGCLLFLRPVFPVG, (SEQIDNO:6122); XM_535696.4, ENPEP, Del, C_7, PRRALRPRPRRPGTRGSVPPAKMTAGTGRTSGCRTSSARCTTTWR, (SEQIDNO:6124); XM_843782.2, LGR6, Del, C_7, PRRAPPSPAPHPPARRPAAAKRTASCCRPTARSSGCLPCPGTWTP, (SEQIDNO:6125); XM_014114725.1, CHTF18, Del, C_7, PRRAPRSPLSCGPRGPRMLLLTAASCGPPGRPEIRS, (SEQIDNO:6126); XM_849540.4, XBP1, Del, C_7, PRRASDSASRT, (SEQIDNO:6127); XM_014116465.1, NOS2, Ins, C_7, PRRASTSSH, (SEQIDNO:6128); NM_001003009.2, TPO, Del, C_7, PRRAVERARTAPLAAWCPPSGRRAGPGPWTPHPVGATWRREARH, (SEQIDNO:6129); XM_014116626.1, HSF2, Ins, C_7, PRRAVGGAGTSKRSCFHWCSLKWPEFSGFG, (SEQIDNO:6130); XM_014107665.1, HDAC4, Del, C_7, PRRCPWTSAWTTSLRCPWRSPPSGSSSCSRSYWPSSRSSSSRGRSSSPSSRGSTSSSPG STRPSCTST, (SEQIDNO:6131); XM_005616382.1, ZNF541, Ins, C_7, PRRGSLWGLPPRPRGGQPACTRWPAISGAPRSQVPQLPLAQPRPPALYCEQHRPPED PFSRPGRRGALRWQ, (SEQIDNO:6134); XM_545878.5, TMC3, Del, C_7, PRRIALHS, (SEQIDNO:6136); XM_005630789.1, SEMA6C, Del, C_7, PRRPCPAAAVSTS, (SEQIDNO:6137); XM_005635227.1, APCDDL1, Del, C_7, PRRPCPCAWAAGGSAPGARCAPLCCSSPGSSPSTGTTAPGRDITATSQTPPATSPPSRS TPRAATPGARRPARSSAAPNSCFRSRGPE, (SEQIDNO:6138); XM_843235.4, LOC607355, Del, C_7, PRRPCSSPCPSRTGFCWGPALPTWPRASWRPEGCR, (SEQIDNO:6139); XM_014122482.1, LOC102152187, Del, C_7, PRRPFPSRVREPARPAVSRSSRRAEGHGLHLEKSFAFLLSLFKPLLSEPLEEAWFLLE, (SEQIDNO:6140); XM_003432681.3, KMT2B, Del, C_7, PRRPHPHFLSLSLHPGGPCSFGHLSLPRAKPT, (SEQIDNO:6141); XM_014121829.1, TMIGD2, Ins, C_7, PRRPPGMWPPPPGHVRPPL, (SEQIDNO:6142); XM_542234.5, MAML2, Del, C_7, PRRPPKQPPPQPHRPRQTITITTSSTCSAVAIMVAVVGSTGSSRHKLQPLGTRGTQP, (SEQIDNO:6143); XM_014118793.1, JRK, Del, C_7, PRRPPLCPARPRPAST, (SEQIDNO:6144); XM_014107535.1, KIF13B, Del, C_7, PRRPPRRRTGRPAP, (SEQIDNO:6145); XM_549235.5, LOC492114, Del, C_7, PRRPRPTQTRRPHFPPSPVPADRPRPPLPRDSTRAPPAVGSRPAPSGRRSMPGPPPSPPS PPSPPLPRPALGRLRALRSL, (SEQIDNO:6146); XM_544046.5, BAG3, Ins, C_7, PRRPRRVPPPPAGLHCHSCPPRRRREPTTASSLCLSPAGDTALPNRGGHRGSSEVPVP SAGCGRGNPAR, (SEQIDNO:6147); XM_005639682.1, PAPD7, Del, C_7, PRRPSLITGSR, (SEQIDNO:6148); XM_014112159.1, LOC490881, Del, C_7, PRRPWRGAETGRDCSPSPGRAEAGVPRRRGSPGPNSNQ, (SEQIDNO:6149); XM_005625732.2, ALG12, Ins, C_7, PRRQPADKAGAPGETPWAVL, (SEQIDNO:6150); XM_014114365.1, SETD1A, Del, C_7, PRRQPMAYPMLCTHKGKKAGGHTPGKPTTCLCL, (SEQIDNO:6151); NM_001204439.1, PPAN, Del, C_7, PRRQRGLASRKKRRTKLSISARQWERSPMRTCSRKQPNADSSPGPQARSHEEKSGGQ MEALTTGLQRPRASPSGTRPSWDGEELSGTAGEAKLDHLRK, (SEQIDNO:6152); XM_534305.5, TSC22D2, Del, C_7, PRRRARPPGLGLRPQHSPPPLAVPVFESSSWTTGAGSPTDAADGRAWNTMSGIQTAA S, (SEQIDNO:6153); XM_014111170.1, PLEKHM2, Del, C_7, PRRRERGPAAQPRAASSRSPARWACLSPR, (SEQIDNO:6154); XM_547217.4, PRR35, Del, C_7, PRRRPPGRWPPGS, (SEQIDNO:6155); XM_005640052.2, JARID2, Del, C_7, PRRRPPWRRPCSTGT, (SEQIDNO:6157); XM_014108769.1, ARHGAP22, Ins, C_7, PRRRQQQGGPPGSRAGPWPGRGGRPRRRRRAQRPRRPDPGLRPLLRGSPGPRGAQ GTAVPAEDRVRHEYQKT, (SEQIDNO:6158); XM_014118210.1, CDK19, Del, C_7, PRRRRHHSRTAPRPTGPRAGLAQGPGLQVAACSTARTRASGRCPPARSPAWGPRVP TPAGPSCRQIISTPVLA, (SEQIDNO:6159); XM_531728.4, FAM83F, Del, C_7, PRRRRRPTSSRWSGR, (SEQIDNO:6160); XM_542033.5, IER2, Del, C_7, PRRRRRRARRSRPAAPRTAC, (SEQIDNO:6161); XM_005631006.1, COBL, Del, C_7, PRRRSPRRPAPWCRLALRTGRKTGRAPRVLDGRCHKSLPEALAGGPPS, (SEQIDNO:6162); XM_014121833.1, LMNB2, Del, C_7, PRRSCGRPRTAGALARASGLSWSTLMGRKWP, (SEQIDNO:6163); XM_014110056.1, LOC102151348, Del, C_7, PRRSLPPRNSPDPSSPARPAAATSPRPPPPPLPQWTKQKVAFPRRMTPPRPQGAWPPR LRL, (SEQIDNO:6164); XM_545710.3, USH2A, Ins, C_7, PRRSRSTQVPCSLFHPCSGQHQRP, (SEQIDNO:6165); XM_014120815.1, GRB10, Del, C_7, PRRSVRSPCTSSPSDACRKKTSSSEPRLCRPSPTPSPSSAAPGARRC, (SEQIDNO:6167); XM_014110313.1, TRIO, Del, C_7, PRRTAARGAARARCPWQSPGLGPPRL, (SEQIDNO:6168); XM_849601.5, PLIN5, Del, C_7, PRRTFPRRSPRPPAAPSTP, (SEQIDNO:6169); XM_005621599.2, UBA1D1, Del, C_7, PRRTSPTPPPPASPPRAGLLQPHPRGAHSTTSHSSRPCGLRHPPPRRQTGHPWPPNRPL QNRGPTLRWRLKD, (SEQIDNO:6170); XM_014117449.1, LOC102154536, Del, C_7, PRRVRSATYIGWSGLIGTVPALPLTTEGFWKPGRGLVSLFAIPCVNNVNFIGLLREGIP I, (SEQIDNO:6171); XM_014120865.1, TDRD12, Del, C_7, PRRWSLLFAE, (SEQIDNO:6172); XM_014114472.1, ZSCAN10, Del, C_7, PRSAGSAARASAAAVICCATCWCTPAPGPTRARSVAAASAATPTCCAT, (SEQIDNO:6173); XM_005625433.1, NOTCH1, Del, C_7, PRSAPPMATIVAT, (SEQIDNO:6174); XM_548709.6, DPYSL4, Del, C_7, PRSARTPALPTTSPPCCPAGTCR, (SEQIDNO:6175); XM_857873.4, PTPRF, Del, C_7, PRSCQGSCWATGYSTTVPMRQSPTS, (SEQIDNO:6176); XM_847178.3, PTPRU, Del, C_7, PRSCSARGPPTSSSSSTPTPSLATGRSCARRLSIACPAARGPRCTPSACRPTSCGTLTPT PSTRSAYCSRARVRAAPAARGRPSSAAPNAQNP, (SEQIDNO:6177); XM_014117950.1, AKNA, Del, C_7, PRSCSLRRAGRPRTVQRQLGTE, (SEQIDNO:6178); XM_533102.5, KMT2E, Ins, C_7, PRSEQHGTAPSTPSAPLLLVLLSKPAALCELSEL, (SEQIDNO:6179); XM_014111003.1, MAP2, Del, C_7, PRSGRISPRPRWRLRVSSLAP, (SEQIDNO:6180); XM_849982.3, TLX2, Del, C_7, PRSGRSRARPSPARRCWSWSGASCARSTWPPPRGQRWPRPCA, (SEQIDNO:6181); XM_003640238.3, IKBKG, Del, C_7, PRSHRTSAAPSASIRPLIWTPCRYTSWSASS, (SEQIDNO:6182); XM_014117000.1, HMCN2, Del, C_7, PRSLAPGSRTHRSPWSGTGRPLCGATPRGSPRPG, (SEQIDNO:6183); XM_014107674.1, TRAF3IP1, Del, C_7, PRSLRCQNLKWCPRWT, (SEQIDNO:6184); XM_014110341.1, AIMIL, Del, C_7, PRSLVLLWR, (SEQIDNO:6185); XM_538386.5, SH3BP1, Del, C_7, PRSPACAPPLQPPSHPLALAALWPPRLCPAVWLAATSGPPQCHPPCPPILPSPPGARA GVHRPPPARPPRGHPHPARSL, (SEQIDNO:6186); XM_005621273.2, FBRS, Ins, C_7, PRSPFGGPTSTCARPQA, (SEQIDNO:6187); XM_003434673.2, C5H1orf233, Del, C_7, PRSPPRPPSAWSSQPSRPACGRS, (SEQIDNO:6188); XM_014110953.1, STK36, Ins, C_7, PRSPPSEPATAGAE, (SEQIDNO:6189); XM_014108277.1, LOC106557868, Del, C_7, PRSPQAPAAAALHLFPGKAASPSRGKAVGRAGGSRGPAGEAAEARRAGRSPRRPRA VSEPEALLGELSPASSSGSRKS, (SEQIDNO:6190); XM_014106443.1, MYO16, Del, C_7, PRSPRGARPAEQRGWPAPTCPRRRSRAPRPREARAAPSPRPPTPPGG, (SEQIDNO:6191); XM_014121988.1, WIZ, Del, C_7, PRSPRRACLSLGPWNRWPIG, (SEQIDNO:6193); XM_543178.4, GJA3, Del, C_7, PRSPRRPRSPSGSRPSALPRPPPRDRPPPRATPGRPHWPQTSTRQPCPRPARGTSTCS, (SEQIDNO:6194); XM_005616171.2, TNNT1, Del, C_7, PRSQKGNVWTSMTSTASAWRKICWSCRRSSTCILNSGRKRKRSS1R, (SEQIDNO:6195); XM_005616456.2, GEMIN7, Del, C_7, PRSQRFPKPWGLQ, (SEQIDNO:6196); XM_005622301.2, FCMR, Del, C_7, PRSQSLTTFEFPEHLQ, (SEQIDNO:6197); NM_001003295.2, HSPB1, Del, C_7, PRSRAPPRPPRPPTAARSAGSSAAACRRSGRRPTAGACPWTSTTSPPRS, (SEQIDNO:6198); XM_014106300.1, FARP1, Ins, C_7, PRSRARRP, (SEQIDNO:6199); XM_848173.4, ZFHX4, Del, C_7, PRSRPRWGPGSCPAPGPGPRPCRRPRPRPRRRPRPRRRRRRRRRPRRPRRCSCPCPW TCRSSRPS, (SEQIDNO:6201); XM_014113960.1, FOXL1, Del, C_7, PRSRPTATSRS, (SEQIDNO:6202); XM_014118510.1, ZFPM2, Del, C_7, PRSRRTFPRTLSTTMATSRPPGSPRTR, (SEQIDNO:6203); XM_005628902.2, PABPC4, Del, C_7, PRSRSRCWENVCSHSSKPCIQTWLEKSQACCWRSTTLSCCTCWSPLSLSAPRWMKL WRFYRLIMPRKKLPRRIQKPN, (SEQIDNO:6204); XM_851907.5, PABPC4, Del, C_7, PRSRSRCWENVCSHSSKPCI- QTWLEKSQACCWRSTTLSCCTCWSPLSLSAPRWMKL WRFYRLIMPRKKLPRRWALLLLLPL, (SEQIDNO:6205); XM_003639850.3, VPS16, Del, C_7, PRSRWSGAAVLAAKRGLSWWHGRGV, (SEQIDNO:6206); XM_844054.5, BNIP3, Del, C_7, PRSSCSSTRSARPRSACGTQA, (SEQIDNO:6207); XM_546245.4, FOXI1, Del, C_7, PRSSPRLPHPAPHASTASSPP, (SEQIDNO:6208); XM_014106943.1, RIN2, Del, C_7, PRSSPRRRGTAPSCCPSWSSRSCAR, (SEQIDNO:6209); XM_541408.4, ZNF579, Del, C_7, PRSSSAPPVSTAKTIQPLRWKKKRSTARPTCVDWEAWPP, (SEQIDNO:6210); XM_533117.5, FDXR, Del, C_7, PRSVWWAVDPLASIPPNTC, (SEQIDNO:6211); XM_543112.5, MYT1, Del, C_7, PRSWPCTRTC, (SEQIDNO:6212); XM_849841.4, APOA1BP, Del, C_7, PRSWSSADLEITEETAWSALGTSSSLATSQPFIIPKGRTSHSSPHW, (SEQIDNO:6213); XM_005621574.2, RBFOX1, Del, C_7, PRTASPRSTRPLTPTPLRSTRARPPSPSTR, (SEQIDNO:6216); XM_003431951.3, HIVEP3, Del, C_7, PRTCLASPKSSCPVPPRCP, (SEQIDNO:6217); NM_001287079.1, NCLN, Del, C_7, PRTCRSSRSR, (SEQIDNO:6218); NM_001287078.1, NCLN, Del, C_7, PRTCRSSRSRCRSSRSSWTQ, (SEQIDNO:6219); XM_014118871.1, LOC106559658, Del, C_7, PRTGEMRSLEQNLAPGVSPMSPAPPTPQRLS, (SEQIDNO:6220); XM_014121010.1, MAP3KL1, Ins, C_7, PRTGQLGCADCPWDALPAL, (SEQIDNO:6221); XM_005628976.2, GJB4, Del, C_7, PRTGTLSS, (SEQIDNO:6222); XM_853562.3, R3HDM2, Del, C_7, PRTHPWSSGVTVNITAWTSVGRNLETYTILTVAPRPTLK, (SEQIDNO:6223); XM_014107603.1, HJURP, Ins, C_7, PRTLGCGHVQG, (SEQIDNO:6225); XM_005635367.1, LAMA5, Del, C_7, PRTLRAPHPGPSAPSKTPTSLGAPCLVTWSSPACRPPPGTGSTCRCWCAPTSREDSCS SRPPSQMAAPPWSSS, (SEQIDNO:6226); XM_014113666.1, RAI1, Del, C_7, PRTNWEASSEPPSSLASGWASRHPRRRPAPVTRPPCRWPRIAAPWAPRPRRQTLPAP RARTSAL, (SEQIDNO:6227); XM_539058.4, SIM1, Del, C_7, PRTNWLPLMELGKNTPSVLQTTNSPHQQAKSVTALLLPTLHHVTTSSRERERC, (SEQIDNO:6228); XM_014111262.1, KIRRE1, Del, C_7, PRTPGSTAAPCSCCRPAPRTTSPAEPSTPSRPPPSSGSGTGRSRRAPWPARNC, (SEQIDNO:6229); XM_846145.3, EGR1, Ins, C_7, PRTPVRLPGRVLRPSLLPLRRAHAPHPHPHRPEALPVSHLHAQLQPQ, (SEQIDNO:6230); XM_005624045.1, DNAH17, Del, C_7, PRTPWSMSRPPS, (SEQIDNO:6231); XM_005621046.2, NYAP1, Del, C_7, PRTRLCLTPWYTRQSR, (SEQIDNO:6232); XM_014121712.1, ARHGAP21, Del, C_7, PRTRPWPGLAPGNAAAPKPAAPPQIAPARRPPRR, (SEQIDNO:6233); XM_005633459.2, MYO7A, Del, C_7, PRTTTRLSSGSTTLQASSTMRAKASWRRTGTPCMETSSSWSTPPETSSSSRSSRLMSP WAPRQGSARPHSAASSSGPWSC, (SEQIDNO:6234); XM_005620608.2, SLC12A4, Del, C_7, PRTVKVMRTTWSSWRC, (SEQIDNO:6235); XM_005626938.2, RNF183, Del, C_7, PRTWALPPGLCPFPSPATTLRGSVSATLSSGSLLT, (SEQIDNO:6236); XM_538929.4, PTK7, Del, C_7, PRVCQSPVYGGSMQEPGYPPMAESSKRAMNWCLLVPPRVMLVSTPAMQPTIVLVSG DKMSISLWPLCPHG, (SEQIDNO:6238); XM_005640629.2, TNS1, Del, C_7, PRVLALAAGPSTPAWLPPGVPA, (SEQIDNO:6239); XM_005626612.1, TPD52L3, Ins, C_7, PRVLLHQPGVGPYRFGFPLCWPRFSLRWPPVQLSVPGTGPGLSS, (SEQIDNO:6240); XM_537319.5, ZBTB14, Del, C_7, PRVRRTASRPRRRSGFRRQS, (SEQIDNO:6241); XM_005621644.2, ZNF213, Ins, C_7, PRVSGGGPWGGSRSADREGGRFFLGAGLCPARRQQGF, (SEQIDNO:6242); XM_537395.5, NFATC4, Del, C_7, PRWARGGRGKNWTQRTPRHAAVWPWGSPLPMALPLLAFPGLHPLGLACIRHHPAR PPHLALGRASLPGQ, (SEQIDNO:6243); XM_014114273.1, CPSF4, Del, C_7, PRWEPVWALLGSMR, (SEQIDNO:6244); XM_014107816.1, HECTD4, Ins, C_7, PRWHSRFPRLSLHPSGDLHVHDQTSPVLLSGNHAGETSLCHSLP, (SEQIDNO:6245); XM_014106282.1, STK24, Del, C_7, PRWKEPTANPSRNLLKPV, (SEQIDNO:6246); NM_001008276.1, RHO, Ins, C_7, PRWLVQSPVSLPSGAQVHPRGHAVLMWDRLLHTQARNQQ, (SEQIDNO:6247); XM_005632035.2, RHO, Ins, C_7, PRWLVQVHPRGHAVLMWDRLLHTQARNQQ, (SEQIDNO:6248); XM_014120952.1, ZP1, Del, C_7, PRWPATSLSLGTSWCLTLTSEMGHRAPSCRMAPSVRQSLLRTGHAVGLGVKGAQRS RSHR, (SEQIDNO:6249); XM_005641932.2, MAM1D1, Ins, C_7, PRWPDLTPGLQ, (SEQIDNO:6250); XM_543071.4, NPEPIL, Del, C_7, PRWPSSATPQKEPPRPLHGWAKGSSMTPGVSASKGRPPCLG, (SEQIDNO:6251); XM_005631778.2, MAML3, Del, C_7, PRWPTPTRTR, (SEQIDNO:6252); XM_014117336.L MKL1, Del, C_7, PRYAASRLPVAAPARVLLGPVGWHVRTAPH. (SEQIDNO:6253); XM_014118288.1, LENG8, Ins, C_7, PSAAASSPAPSALQPPAWGSCSEQWPPAWNSPSHTAQPGRACLRPGLWATC1L, (SEQIDNO:6254); XM_014106807.1, DCLK3, Del, C_7, PSAAQRGTRMSSL TSSSWATSNSWPLTGTIFLTLPKIW, (SEQIDNO:6255); XM_005638682.2, SHF, Del, C_7, PSAASLKSCTTTPAASCPSRGPSTCPCSTLWPFGLC, (SEQIDNO:6256); XM_014118741.1, SCRIB, Del, C_7, PSACHWWVLMTCARCRRRKPESCSRRGRS, (SEQIDNO:6257); XM_547396.5, SERTAD4, Ins, C_7, PSAFTELFPPGGF, (SEQIDNO:6258); NM_001003202.1, TJP3, Ins, C_7, PSAGKFSGFQNHLGTRRPEAQQL, (SEQIDNO:6259); XM_014106883.1, PTK6, Del, C_7, PSAHPPHTS, (SEQIDNO:6260); XM_014108635.1, ZNF641, Ins, C_7, PSAKVPCVH, (SEQIDNO:6261); XM_014118847.1, ANKRD17, Ins, C_7, PSALFERYRFNHSSR, (SEQIDNO:6262); XM_846038.3, C17H1orf56, Del, C_7, PSALGSDPPPSFSLAPAPAPAPAPAPVQPLLFGDESGSGWRIFGTVCLQCSQRCNQ, (SEQIDNO:6263); XM_003639867.3, ZFP64, Ins, C_7, PSALGVPERGGRDEPARCPADHSRPGRWGHPAPDAHPHHPRQPPGRLRQPDFHHQF GYYMH, (SEQIDNO:6264); XM_014106638.1, NOD2, Del, C_7, PSALPWPLCCGTSGGLWPCSWTTTLLVTLAWSSCCRASVSARLFTCEITISQTEASVS SSSMLCTASSCRS, (SEQIDNO:6265); XM_005635245.2, PHACTR3, Ins, C_7, PSALRISGLRDPHSPGEEEQQAGHPGQDLQTLEMEEEEKRKTEADDVRAGEEDDRQ ARSGGAHQEGSAGDDGAGC, (SEQIDNO:6266); XM_014109616.1, SNX33, Del, C_7, PSALRLSTAPFLTRAAPMKLWVRCSPSSPRMTSSRCSTRCPSTRACSQISLTSSTCRKA PSPR, (SEQIDNO:6267); XM_014117109.1, ESYT1, Del, C_7, PSAPRCSRTARALLRSIGVEAKGELGWQQRFRAVGGE, (SEQIDNO:6268); XM_005619991.2, EFNB3, Del, C_7, PSAPTMRR, (SEQIDNO:6269); XM_014117108.1, LOC106559343, Ins, C_7, PSARAAGLPRDAGTAAA, (SEQIDNO:6270); XM_014119796.1, KDM7A, Del, C_7, PSARGRCRST, (SEQIDNO:6271); XM_005621365.2, ATXN2L, Del, C-7, PSARTNTSQPQPLR, (SEQIDNO:6272); XM_547204.4, LMF1, Del, C_7, PSASGTWRTTSAPGSGRTRPWMWT, (SEQIDNO:6273); XM_014121956.1, DOCK3, Ins, C_7, PSASPKPAAWSLLPT1, (SEQIDNO:6274); XM_014121827.1, PTPRS, Del, C_7, PSATGRSCGTKSH-PRTSR, (SEQIDNO:6275); XM_005631734.1, MUC5AC, Del, C_7, PSAVLRNRLCQAR-TAAVCPVLYTHPTPVQRAQCTTSSRSSAS-KAAAPPGLCTSPTAR ATVETAPPGTWRPRP, (SEQIDNO:6276); XM_536750.5, CDH15, Del, C_7, PSAYPRTTSASRIPWCRSNRTSSHWAVSSTAS-RGPAWMRSPRACSPLTSSPGRCS, (SEQIDNO:6277); XM_014108022.1, LRRC43, Del, C_7, PSCACWA-VACWPWSPCWRGSHLCPPCATLG, (SEQIDNO:6278); XM_014115762.1, CDH24, Del, C_7, PSCLRAST-SSLWWKRRGQAPWWAGCGPRTQTWGTMPSWHIAS-WTERGLKPSASA QTPRVEMGSSLSARP, (SEQIDNO: 6279); XM_531753.4, BPIFC, Del, C_7, PSCQFLLHCQNAVTLCSMLESPSFSLNLHPLLTL, (SEQIDNO:6280); XM_014116949.1, KCNT1, Ins, C_7, PSCRGNERMAPTWLSCSACHSLQAASSAS-ACWTRCFTSPL, (SEQIDNO:6282); XM_858879.4, EPHX1, Del, C_7, PSCRPAAPQSPC, (SEQIDNO:6283); XM_541489.6, MED25, Del, C_7, PSCTHHLPSPGPHSF-PRELRCQVRCC, (SEQIDNO:6284); XM_005616290.2, MED25, Del, C_7, PSCTHHLPSPGPHSF-PRELRCQWQNERETERATCFEKNGSEPISLWK, (SEQIDNO:6285); XM_005623705.2, TMED8, Ins, C_7, PSD-GASMHLDLCQDERI, (SEQIDNO:6286); XM_014116993.1, NUP214, Ins, C_7, PSEIHCSSQPVPVSLPVTEIL, (SEQIDNO:6287); XM_535042.5, TACC2, Ins, C_7, PSERDTTRAR-GRVSRPQRGD, (SEQIDNO:6288); XM_014121412.1, NCKAP5, Ins, C_7, PSERILCSYYFF, (SEQIDNO:6289); XM_005617055.2, KIAA1462, Ins, C_7, PSESRPRPPD-EDEGDSYDPSRVERV, (SEQIDNO:6290); XM_854764.4, MAP1A, Del, C_7, PSFILHCWEMGSTLLV, (SEQIDNO: 6292); XM_536461.5, FAT2, Del, C_7, PSFREGTVN-KEERTARPCPAWKVALASHLLKVPPVTALTLI-WETGVKWKQGAAQK DTV, (SEQIDNO:6293); XM_014116591.1, NOVA2, Del, C_7, PSGAASPWPRSCLPSTTSPYTPATMSTSHP-SCLTPLWNAPTLLVPTCKSERAHTRLKV ETRPL-TALPPPPVPLQRKANTS, (SEQIDNO:6294); XM_845495.4, DGKZ, Del, C_7, PSGDLGGTRCPPKVKS, (SEQIDNO:6295); XM_014107649.1, LOC106557788, Ins, C_7, PSGEQRGPSPRSRGLPGAGGGRPYSALQPARRTP-GAESGGPRGRFWRAPTSQRP, (SEQIDNO:6296); XM_005640123.2, BTN1A1, Ins, C_7, PSGGDFPGL, (SEQIDNO:6297); XM_547146.4, NMRAL1, Del, C_7, PSGGGLGCKVPGGGRGAGCSVLPSSVSHPGCG-GRWGPGRGRGAER, (SEQIDNO:6298); XM_005624366.2, FMNL1, Ins, C_7, PSGHLGSLAL, (SEQIDNO:6299); XM_545182.4, ICE1, Ins, C_7, PSGILTT-PEHFTFFARTRNLLWRVYRFQ, (SEQIDNO:6300); XM_014119925.1, ZNF672, Del, C_7, PSGRAAVPCA-PAPSGRARCGPTRRGRTRGPCPPCPAPRPSAAR-RAHGPSAATRSHGA AAARPRAPASPQGLRPRRPRT-SAVCAGRASARAPH, (SEQIDNO:6301); NM_001003009.2, TPO, Del, C_7, PSGR-RAGPGPWTPHPVGATWRREARH, (SEQIDNO:6302); XM_548107.3, KRT36, Ins, C_7, PSGSQQDPG, (SEQIDNO:6303); XM_005626260.1, ATP6V1B1, Del, C_7, PSGTAKPWWHCQRFCWLNIALCQQAPLKRGPL-RASCRCPSQRGALWAGA, (SEQIDNO:6304); XM_005642488.1, C1QTNF8, Ins, C_7, PSGTDSSLRP-PAPPGATCGA, (SEQIDNO:6305); XM_003639985.3, INPP5F, Ins, C_7, PSGVHLCR, (SEQIDNO:6306); XM_005621293.2, SRCAP, Ins, C_7, PSHKPPLGLGA, (SEQIDNO:6310); XM_014112912.1, ARIDIB, Del, C_7, PSHPPSEGRSPFLLAQSRRRSQS, (SEQIDNO:6311); XM_538386.5, SH3BP1, Ins, C_7, PSHPPST-PAQEPCLRDR1, (SEQIDNO:6312); XM_014111810.1, PRICKLE3, Del, C_7, PSHPQDSPASLTHPWKMVPLVA-RAPPASASVTLWYPREAHGEP, (SEQIDNO:6313); XM_014113666.1, RAI1, Del, C_7, PSHSPCQGAWANMMTT, (SEQIDNO:6314); XM_014122040.1, BRD4, Del, C_7, PSHSRHPSSST-SPRHGLCTCSPCSSLPTSSSPRRPRASSPRTR-PRASSRRLHSPPSLSRSS SITLHPGTTSRTPILPVT-SEKPPPRL, (SEQIDNO:6315); XM_543689.5, CACNB3, Ins, C_7, PSIASQAEAKAGRACSPL, (SEQIDNO:6317); XM_014111820.1, SLITRK2, Del, C_7, PSIESTSFSS-METS, (SEQIDNO:6318); XM_014112907.1, SEC24C, Del, C_7, PSIFNIWIILANVSMLMTVLSYPWALMN-SWPL, (SEQIDNO:6319); XM_847901.4, HNF1B, Del, C_7, PSIPIPPGFHLRWWSRIPAASVRLPTCLPVN-SAPSKPG, (SEQIDNO:6320); XM_014120097.1, POU2F2, Del, C_7, PSIPSPLSLPHPRPPPTAQIPAL-KAATRPSACRA, (SEQIDNO:6321); XM_014118383.1, UHRF1BP1, Del, C_7, PSIQHLQALSPSL, (SEQIDNO: 6322); XM_005637906.2, TUBGCP2, Ins, C_7, PSI-SAQGRRPCPV, (SEQIDNO:6323); XM_014116482.1, SOCS?, Del, C_7, PSIS-SVRSTGPTQAALQPAFESWRSVVGTGDQ, (SEQIDNO: 6324); XM_014111152.1, HHIPL2, Del, C_7, PSIWSWGF-GASGRWWSARPMQLISTTPRTLRRPSGTFLASALT-TALPSILTATLPFPY, (SEQIDNO:6325); XM_014107872.1, VPS37B, Del, C_7, PSKDSLHSS-CLHTHPLFPRDPRPGCLHTSQASSSS, (SEQIDNO: 6326); NM_001287169.1, SLC7A8, Del, C_7, PSLAFD-SWLPSAYCSSHGSTVPVCGGPPGFKTFSQLGSSWPWP, (SEQIDNO:6327); XM_005632035.2, RHO, Del, C_7, PSLAGPGTSQRACSAHVGSTTTHSSQK-STMSPSSSTCSWSTSPSP, (SEQIDNO:6328); NM_001008276.1, RHO, Del, C_7, PSLAGPVSCLTPLWCSGTSQRACSAHVG-STTTHSSQKSTMSPSSSTCSWSTSPSP, (SEQIDNO: 6329); XM_540216.5, DOK1, Del, C_7, PSLAPRLSAWT-PRSAPTCWRPTRRPAPPGCRPCAETPFRKAAGLWR-LRKTHPSFLPW RCWRTRCIVPPGKDPSSG, (SEQIDNO:6330); XM_003639255.2, LOC100856208, Del, C_7, PSLEQRRTLILVPSSTSLPVCPTYGTSSAS-CSVPLWSLCARPQAI, (SEQIDNO:6332); XM_547068.4, TBX6, Del, C_7, PSLGQIPASRLPWQRATATLIWTLPS-WIASSPGLKLLPAPWPLPQPCPRYPQPWALSR PPQPQRSFIRSPESA, (SEQIDNO:6333); XM_545660.5, INHA, Ins, C_7, PSLGRAASGPLRPPSADQPRP-GAAAALPRLFLRSRAR-GHPLLGGPHAGQAAQRRGED PPLRLPAALAVVS-GRAAPAPEVPRGARRPR, (SEQIDNO:6334); XM_014115267.1, ENAH, Del, C_7, PSLHLDFLRH-PRPKTIAL, (SEQIDNO:6335); XM_005618169.2, ANKRD34B, Del, C_7, PSLIPVSI-TRFPASFLVVRKCLCQQFLCSLKNSKVKKCC, (SEQIDNO:6336); XM_014117542.1, BCL11A, Del, C_7, PSLLCNPPLLPPSPRSSPSRASSAARRSNFRATSWCT-GAATRARSPTSATCATTRARRP AS, (SEQIDNO:6337); XM_005636179.2, SETD1B, Del, C_7, PSLLHPHLHPLL-SPPSCPLRS, (SEQIDNO:6338); XM_849796.4, TCF7L1, Ins, C_7, PSLPAPPPRVPAHSSADLSPLLPSHTPCPPGP-PRAPGPASFLGHQVCPL, (SEQIDNO:6340); XM_014115373.1, DCST1, Ins, C_7, PSLQAPDP-NEAHPHQRDGLLALQG, (SEQIDNO:6341);

XM_014116580.1, PNMAL2, Ins, C_7, PSLRRGGLPASP-PASPRLSVPASQVAERPGGRTEMRVPPARRGPR, (SEQIDNO:6342); XM_005638009.2, CHD7, Del, C_7, PSLR-SPMVAVAVRWESTLACRMKGTGSHSWTVAPCGAPGL-CRCQTRYGPPTSSSH SHSRPSPLHRGL1HRATLSTCS-RWAATWHVGIFPCSSMVSHSRG, (SEQIDNO:6343); XM_539966.5, PLEKHA2, Del, C_7, PSLRVATV, (SEQIDNO:6344); XM_005620646.2, TAF1C, Del, C_7, PSLSLPVATPSPHSPCWSPGVSGGCRSV, (SEQIDNO:6345); XM_005617981.2, PRDM2, Ins, C_7, PSLSSRVDCCHATASTPSHRPSSGPLF, (SEQIDNO:6346); XM_014121529.1, THSD7B, Ins, C_7, PSLWWVPVSQPDRVKSL, (SEQIDNO:6347); XM_541780.5, CAMK1, Del, C_7, PSMTRMMPNSLNRF, (SEQIDNO:6349); XM_014120337.1, BIRC6, Ins, C_7, PSNAVSPQTVHD, (SEQIDNO:6350); XM_532844.5, SLC25A4, Del, C_7, PSNPHRSSM-PANRSVPRSSTKGSLIVW, (SEQIDNO:6351); XM_005639524.2, ARHGAP31, Ins, C_7, PSNSSGG-GASNPAAKGRPRGSRPVQELEDTGVHR-PAEARGQPGGPSPVSGAGGPSRT KGKAKFKECCSGS, (SEQIDNO:6353); XM_005623664.2, PGF, Del, C_7, PSNWPCLLEMAHQRWKWCPSSKCGDAATAGHWR-SWWTSCRSTRMRWSTCSTHPA SPCCA-VVAAAETKTCTVCRWRRPMSPCSPTRHRGRT, (SEQIDNO:6354); XM_014116070.1, PGF, Del, C_7, PSNWPCLLEMAHQRWKWCPSSKCGDAATAGHWR-SWWTSCRSTRMRWSTCSTHPA SPCCA-VVAAAETKTCTVCRWRRPMSPCSS, (SEQIDNO:6355); XM_005616367.2, C1H19orf68, Del, C_7, PSPAARPSSSSS, (SEQIDNO:6356); XM_533813.5, DOCK3, Ins, C_7, PSPACPDSAQVSSPPYPGL-PHQPPVGSGRQQLYTVWQCQQRRVLPERE, (SEQIDNO:6357); XM_005642449.1, ARIH2OS, Ins, C_7, PSPACRGKQGRDPRRTLTGSRSP, (SEQIDNO:6358); XM_848813.4, ACD, Del, C_7, PSPAGPP-PAVGPREKLCTLSPAPGCTSRRMTSEF, (SEQIDNO:6359); XM_844620.4, C5H17orf74, Ins, C_7, PSPAHL-HAAQQDPRRQCRLPGV, (SEQIDNO:6360); XM_014111220.1, ELK4, Del, C_7, PSPAPGPPAATTIYT-PACILPSLSTL, (SEQIDNO:6361); XM_005625737.2, ZBED4, Del, C_7, PSPARTARRTGRRGIPRLPRAL-RAPGGGRLCGSTSTCRPWTTPRPCASTA, (SEQIDNO:6362); XM_014116470.1, RARA, Del, C_7, PSPAST-SLALSVKTNLQATTMGSAPVRAARASSAAASRRTWC-TRVTGTRTVSSIR, (SEQIDNO:6363); XM_014108967.1, PDZD7, Ins, C_7, PSPATPCRSPAPKA, (SEQIDNO:6364); XM_014112392.1, MEF2A, Del, C_7, PSPDRKW-GAPLWTV, (SEQIDNO:6365); XM_005640788.1, NUAK2, Ins, C_7, PSPGAAPP-SQRHPQTQWFSPLSHPSNLAQASWTRC, (SEQIDNO:6367); XM_005640789.2, NUAK2, Ins, C_7, PSPGAAPP-SQRHPQTQWQVLLHSPGAPDPLHLRLPG, (SEQIDNO:6368); XM_005628297.2, SCX, Del, C_7, PSPGREMPRAPSSWREAAEGRGPLL-PAASGAGRRGGGRAGAGEGPPPL, (SEQIDNO:6369); XM_005619930.2, MINK1, Ins, C_7, PSPGR-PRASGPPFPNSAYAEAGGAPGGTAQEPGGTPGPTEA-ICSACTPIPVPAGPAHP KPGCLPSLP, (SEQIDNO:6370); XM_014116619.1, SP2, Del, C_7, PSPHHGNSSPSNLPLSLSVLARIASESCPPKETSFR-FRGHN, (SEQIDNO:6372); XM_544370.5, ZNF366, Del, C_7, PSPITCTSSTEMRV, (SEQIDNO:6373); XM_533193.5, CKAP5, Del, C_7, PSPLPRT-CCTANSLSSGSPGSSSTSTQTWILTRLTLQEA, (SEQIDNO:6374); XM_003640232.3, RAI2, Del, C_7, PSPLT-PRCPPWCPRPPSWCPTL, (SEQIDNO:6375); XM_547735.5, ZFHX2, Del, C_7, PSPMSPQPQRLQSLLNWLLQGRGSPGRLTSCCQAV-LASPPWM, (SEQIDNO:6376); XM_849952.3, INTS5, Ins, C_7, PSPPSTPTLPCPCWGTWSRRCGAGSTAGAV, (SEQIDNO:6377); XM_014107801.1, CCDC92, Del, C_7, PSPPTAAQVSGTAQPASSSTRLMWGWPIASTML-PHHTPSLSWRRWQSTR, (SEQIDNO:6378); XM_005633780.1, LOC102154018, Ins, C_7, PSPPTPP-DASFPASIS, (SEQIDNO:6379); XM_014112086.1, LOC106558514, Del, C_7, PSPRALCSGAQGSP-GAQDLCY, (SEQIDNO:6380); XM_547068.4, TBX6, Ins, C_7, PSPRGPSFAPRSQPEPGQPGAVERVQFCGNRD-DHHQSWEAHVPCLSSVSHWPGP, (SEQIDNO:6381); XM_846419.3, ZNF362, Del, C_7, PSP-SAAAKRSRRRTQGGRLSS, (SEQIDNO:6383); XM_003431800.2, ZNF16, Ins, C_7, PSPSAARLGHQD, (SEQIDNO:6384); XM_545695.2, AVPR1B, Del, C_7, PSPSAPASVGAPGLKAHPKTQRRWTQRPPQRPSPF, (SEQIDNO:6385); XM_014116208.1, ITGB4, Del, C_7, PSPSKMLSA, (SEQIDNO:6386); XM_014109372.1, BCL2L10, Del, C_7, PSPSLSLRPLRSRARL-WAWPLRPEQVRTGFPSEALLGT, (SEQIDNO:6387); XM_014111262.1, KIRRE1, Del, C_7, PSPSPGPKRIQTWGPGLLAPHPRLLSLPRS, (SEQIDNO:6389); XM_005640916.2, KIRRE1, Del, C_7, PSPSPGPKRIQTWS, (SEQIDNO:6390); XM_014119710.1, PPP1R13L, Del, C_7, PSPSPSFHPSP-SHSPRLNRLPQPPSLPHRLGPL, (SEQIDNO:6391); XM_005634655.1, MED12L, Del, C_7, PSPSRPRSPRVR-PLVSKRCSRSS1, (SEQIDNO:6392); XM_014116529.1, NAGS, Del, C_7, PSPSSPPGPRQAARWCSGTSRPF, (SEQIDNO:6393); XM_003639997.2, CALHM3, Del, C_7, PSPSSSAASSPTGSRW, (SEQIDNO:6394); XM_546571.4, KIF1C, Ins, C_7, PSPSVPFTSPRTQWGA-GAIVLPQCRAPDWA, (SEQIDNO:6395); NM_001168461.1, FOXP3, Del, C_7, PSPTPPS-SAGPSWRLLRSSGHSMRSTTGSHACLPSSGT-TLPPGRMPSATI, (SEQIDNO:6396); XM_005627317.2, FOXP4, Del, C_7, PSPTTPCPMD-SPLCSHLGETAPPMRRRQAPTP-STDMESVSGQAVRPCVKTWASLSNT STQSTPWMT-GAQPSAGCRCRWYSSWRSSSPRRVRGCRP, (SEQIDNO:6397); XM_005630840.1, LELP1, Del, C_7, PSPVPSPVLLNAHLPAHPQS, (SEQIDNO:6398); XM_005635865.2, INPP5D, Ins, C_7, PSQEDHVLVSLQGAGKDAG, (SEQIDNO:6399); XM_005621049.2, PILRA, Del, C_7, PSQEEPPGGDPI-LYP, (SEQIDNO:6400); XM_005621048.2, PILRA, Ins, C_7, PSQEEPPGGDPILYPKGL, (SEQIDNO:6401); XM_005636883.1, KMT2D, Del, C_7, PSQGHWAVR-PLLLPPPFSLAAPQPPPACLPLRTGS, (SEQIDNO:6402); XM_014106895.1, LOC100683453, Ins, C_7, PSQGRAE-PTPGPHPPRMVHSPGRGQSPGPEGRRSRLDSGARM, (SEQIDNO:6403); XM_014118232.1, ZNF524, Del, C_7, PSQGRSPRWHRG, (SEQIDNO:6404); XM_014106893.1, MAST4, Ins, C_7, PSQGVPPM, (SEQIDNO:6405); XM_843647.4, PDLIM3, Del, C_7, PSQMCTGCSM-TIGMNLLSLASRALSECSRN, (SEQIDNO:6406); XM_014113564.1, CHD3, Del, C_7, PSQPAFRCPSAAF-SAGWPARARSLTPHRPFPRGPTLHLRDTGRP-SAPHPSGPWPPQAP TTARCLPGSSQPPPTALQCW, (SEQIDNO:6407); XM_546802.6, WFDC1, Del, C_7, PSQRAPRL, (SEQIDNO:6408); XM_005616859.2, BCL2L12, Del, C_7, PSQRRKPYCGSWLPCWRKRLKSSTR-SWPRTPPCVGSWPASPPAPSPAWWSCSLAGR TAL-CPAVHAPPCPAQGLHRLPRSPWPAWPWPWS, (SE- QIDNO:6409); XM_014116608.1, C9H17orf96, Ins, C_7, PSQRTAPPPGTDAPHLEHLQPPRLLPLPPGPGGGG-GRRLRAGILASPAGRR, (SEQIDNO:6410); XM_855303.4, ARHGEF15, Del, C_7, PSRISICPRK-MESKQGTILMKLLQALLQHPWRAGTRRNWRS, (SEQIDNO:6412); XM_003431676.3, CFB, Ins, C_7, PSR-LEPYPPRYHPYD, (SEQIDNO:6413); XM_014122224.1, RFX1, Del, C_7, PSRLP-PLLPPSPNMSLSCRAPSPRHSHQAARNNM, (SEQIDNO:6414); XM_844789.4, CBX6, Del, C_7, PSRL-SPRRCASSIARSSLGSPSETASSST, (SEQIDNO:6415); XM_014120094.1, POU2F2, Del, C_7, PSRLSRICPRPNSC, (SEQIDNO:6416); XM_005623084.2, TXNDC2, Del, C_7, PSRLTP-PILQKKLSHPRKVKSPIPRKKTS, (SEQIDNO:6417); XM_005616542.1, TMEM91, Del, C_7, PSRNLVNPSWGLPFGRRLLQSP, (SEQIDNO:6418); XM_843925.4, DAP, Del, C_7, PSRPCSSQE, (SEQIDNO:6419); XM_548165.4, OSBPL7, Del, C_7, PSRRAMR-SQRTSSSGKT, (SEQIDNO:6421); XM_005640908.2, LOC100685881, Del, C_7, PSRRPAASSSCTPCTPWA, (SEQIDNO:6422); XM_014118210.1, CDK19, Del, C_7, PSRRQPPRRRRHHSR-TAPRPTGPRAGLAQGPGLQVAACSTARTRASGRCP-PARSPAW GPRVPTPAGPSCRQIISTPVLA, (SEQIDNO:6423); XM_548725.4, UNCX, Del, C_7, PSRRRPGQALELPAPPGSPPCAGPQSPAPSPDPARR-RARRRWTWT, (SEQIDNO:6424); XM_003435655.3, NKRF, Del, C_7, PSRRRRCRPSRRPRPSQCWSSGAI-ATKVTGSGLCGAASSVGTCTAIPGLPWTSSSRSPP PGPTTFSWAAGTAHA, (SEQIDNO:6425); XM_853188.4, RARG, Del, C_7, PSRSGAPPGEEGE-SAAGPRCS, (SEQIDNO:6426); XM_014109338.1, DUOX1, Del, C_7, PSRSTSSYLATADAGPCCSR-SPRSMTWCCCLTWRKSGRCWWKTFGGP, (SEQIDNO:6427); XM_014109349.1, DUOX2, Del, C_7, PSRSTSYCPATVDAIPCYSRSPRSMTWCC-CLTLRKSGAPLCSICRTSVCSGLWALTWL R, (SEQIDNO:6428); XM_005640913.1, LOC488620, Del, C_7, PSRWPAASSSYTPCTPWA, (SEQIDNO:6429); XM_014113233.1, DNAH9, Ins, C_7, PSS-CQQRHGRGDDPHGPRGQGAQGPQLEGREGHHGQG-GRFPGLPHQL, (SEQIDNO:6431); XM_014121835.1, JSRP1, Del, C_7, PSSDPQLRSPAPIWAPPSP, (SEQIDNO:6433); XM_014110912.1, BARD1, Ins, C_7, PSSGGSAP, (SEQIDNO:6434); XM_005629808.2, KAT6A, Del, C_7, PSSHSSHRRPPHRHHSPSPSSHSLRPHRSSSPRCHSAV, (SEQIDNO:6435); XM_014112830.1, CNKSR3, Del, C_7, PSSKKAPQPHTGSQGPQRRGSWSGAQTLSGAA-GATSVRISTAAPPSRSRRRGPERSRP PPQRPR-PLQNRPCWSAG, (SEQIDNO:6436); XM_014110273.1, KIAA1407, Del, C_7, PSSLAPTSSSEPRAGKQNP-SAGVTSTTATSSSNS, (SEQIDNO:6438); XM_014114806.1, HIAT1, Del, C_7, PSSLEPVPYCWLCLLPCLFQNIPI, (SEQIDNO:6439); XM_014114365.1, SETD1A, Del, C_7, PSSLHPLLLHPL-LILHTWLPCPLLILPTSGHTSSHRALMGRLPP-STPHLLRHPPTFMTL, (SEQIDNO:6440); XM_531921.4, KDM3B, Del, C_7, PSSLRLQQE, (SEQIDNO:6442); XM_005641757.2, LOC102155093, Del, C_7, PSSLTWVDPAVPSSFRSRIAYGFFR-SHCCWGHLSRSCHPFLWSSCLLCPGFLHLSLCA ATLPWPVRLSYHP, (SEQIDNO:6443); XM_845974.4, KCND3, Ins, C_7, PSSN-PRGGKSASPRQPRPQHEHSFHSQQCCQGLCLV, (SEQIDNO:6444); XM_014122258.1, DNAH1, Del, C_7, PSSPASTGCLGSSFSSALRTPVCSRNAWKPMP-CARTQRLCCCTICTWTACPPRAASSS VSRA, (SEQIDNO:6445); XM_014118376.1, GRM4, Del, C_7, PSSPNRNVWSVSSVLQGALSPSWWPTSFASSRSPR-SATPPQPPT, (SEQIDNO:6446); XM_005638006.2, TOX, Ins, C_7, PSSPPDQPTSSPASQHAAAPATRHAAAP-WEPAPHAGPVCLTLTDHAAGNSSTRLSDY NQSYIH-SCTSGNPSNGVCAFWVQKPSRPAGGLE, (SEQIDNO:6447); XM_005626415.2, AKAP2, Del, C_7, PSSPRMISG, (SEQIDNO:6448); XM_862165.4, ATP2B3, Del, C_7, PSSPRPSCSWCGRPCRT, (SEQIDNO:6449); XM_856636.4, BRPF1, Del, C_7, PSSPSWAPY-VSASGVGAPGPVRAQTATVINPQKTPQWTYQP-MASAAEISQ, (SEQIDNO:6450); XM_005619086.2, ZMIZ1, Del, C_7, PSSPTLRT-CPTTWPPSRNPSVTPCRKLCHTLAVLTSPIP-PYNKVCTSHTPAASQGLHYI TVGLLLLLPSLPGNRHRPLPATIHTVT, (SEQIDNO:6451); XM_005619085.2, ZMIZ1, Del, C_7, PSSPTLRT-CPTTWPPSRNPSVTPCRKLSFQNSQIPMSSSRTWIPLT-CRAIVTMTSCLSLR TT, (SEQIDNO:6452); XM_014121819.1, CAMSAP3, Ins, C_7, PSSRGPL-SNPSPCCQGPSGGRGGPQAGGLHSA, (SEQIDNO:6453); XM_545710.3, USH2A, Del, C_7, PSSRMVT-CLAMRSACRILTSP, (SEQIDNO:6454); XM_014114715.1, UNK1, Del, C_7, PSSRPPSSPSPER-WARRPRPTPWARAPAVRSWPGSGGSWTRPRGRSGN-GRSPGSR, (SEQIDNO:6455); XM_014114719.1, UNK1, Del, C_7, PSSRPPSSPSPERWARRPRPTPWG, (SEQIDNO:6456); XM_014116795.1, PHF12, Ins, C_7, PSSRRWYLGHRSQPTILLT-SAIIRWQGQPRHVIHRKRFNRTLFPSQLYCH-GGPHQLTS SNGC, (SEQIDNO:6457); XM_014107017.1, CHD6, Del, C_7, PSSSTAGMGNLQ, (SEQIDNO:6458); XM_542210.4, GRIN3B, Del, C_7, PSSTPSS-WTSRSSTTKSPSTRTVNC, (SEQIDNO:6459); NM_001287125.1, CDH1, Del, C_7, PSSTQPR-TRDGCLRTRLTSKSLYSK, (SEQIDNO:6460); XM_014116630.1, GSK3A, Del, C_7, PSSTSVLEN-SPSSHLSTPFSSLLT, (SEQIDNO:6461); XM_003432782.4, PDE4A, Ins, C_7, PSSWRVGISRR-SYL, (SEQIDNO:6462); XM_544410.5, SALLI, Del, C_7, PSSYLRAVPATPSFHPTAALPPTLTFWRQR, (SEQIDNO:6463); XM_014116573.1, DACT3, Del, C_7, PSTAGPGALARPARLIWPDAIKSELGPA, (SEQIDNO:6465); XM_014118244.1, SYNGAP1, Ins, C_7, PSTAPPT-PAADH, (SEQIDNO:6466); XM_003432781.3, PDE4A, Del, C_7, PSTCGGSRGPPFVSSSAATPTARSAQSPS-GRHTGP, (SEQIDNO:6467); XM_005638522.1, IGDCC3, Del, C_7, PSTCRRSLCRPPRSGCPGMNPWSTPRRL-LAMSCTSGRLLTPRSWSTRRHSAKAPFSIC, (SEQIDNO:6468); XM_014117439.1, KCTD17, Del, C_7, PSTCTVCCSARRRS, (SEQIDNO:6469); XM_005619461.2, LOC102153808, Del, C_7, PSTDCGGGSLGQHRICFGVKNFVRHTCKTTT, (SEQIDNO:6470); XM_005617918.2, KIAA1522, Ins, C_7, PSTGGQWEGLPQWGQHC, (SEQIDNO:6471); XM_540976.5, ARHGEF4, Del, C_7, PSTGIS-RMWKQPYMP, (SEQIDNO:6472); XM_547530.4, ISG20L2, Del, C_7, PSTGRLTAQRMPLCL, (SEQIDNO:6473); XM_535422.5, FMN1, Ins, C_7, PSTGTAQHAPE, (SEQIDNO:6474); XM_014115765.1, EFS, Del, C_7, PSTLPLPT, (SEQIDNO:6475); XM_003432343.3, LRRN4CL, Del, C_7, PSTLQPAEQN, (SEQIDNO:6476); XM_541835.5, IL17RD, Del, C_7, PSTPESRCWRSL-TRAWC, (SEQIDNO:6477); XM_005624150.1, CBX4, Del, C_7, PSTPHMHSYRALAPEDRVGPYVIPHLE-AAELARFFYAVSPPFPLQDITRGNPRRTSWI PGC, (SE- QIDNO:6478); XM_005616728.2, GRAMD1A, Del, C_7, PSTPSHGPMTASP, (SEQIDNO:6479); XM_005621146.2, SDK1, Del, C_7, PSTPSSTTT, (SEQIDNO:6480); XM_005620012.2, BORCS6, Del, C_7, PSTPTCCGTWSG, (SEQIDNO:6482); NM_001003373.1, C5AR1, Del, C_7, PSTPTMALPPWTPTYLWMSLSTPPSCRSRI, (SEQIDNO:6483); XM_843127.2, SH2D4A, Ins, C_7, PSTQAAVPAPSGVPSAASQNPGSDKDGIELFPGGHHSVVQRGAATSASRLPEGLRHY SALVPRDSYIEESK, (SEQIDNO:6484); XM_014110056.1, LOC102151348, Del, C_7, PSTRMWREPSPCSPSHHSPVTAACSQ, (SEQIDNO:6485); XM_005626061.2, FER1L5, Del, C_7, PSTSGPESLEGMSCAALSGRLPKWT, (SEQIDNO:6486); XM_005620294.2, IGSF9B, Del, C_7, PSTSRPRRVAV, (SEQIDNO:6488); XM_005618506.2, MFSD10, Del, C_7, PSTSRRLRTPA, (SEQIDNO:6489); XM_843488.4, NAV1, Del, C_7, PSTSSKGT, (SEQIDNO:6490); XM_014111044.1, ABI2, Ins, C_7, PSTSSPRRL, (SEQIDNO:6491); XM_005625732.2, ALG12, Del, C_7, PSTSTCRQGWCSWRDAVGRP, (SEQIDNO:6492); XM_014121804.1, CACNA1A, Del, C_7, PSTTLSSK, (SEQIDNO:6493); XM_014120931.1, MUC2, Del, C_7, PSTTTTPACSTPASCPAQAWSVPACRPTRPCAPTRASVSTGGTTPTGFAR, (SEQIDNO:6494); XM_005621773.2, RHBDF1, Ins, C_7, PSTVCGAVPAGHAEDHRPPGPGPGLPRGG, (SEQIDNO:6495); XM_005635260.2, OSBPL2, Del, C_7, PSVHFIQKASIRTSCFTAPSTRS, (SEQIDNO:6496); XM_005632499.2, HEMK1, Ins, C_7, PSVHSSPGN, (SEQIDNO:6497); XM_540177.5, FBLN7, Ins, C_7, PSVLPCSERPSRWQKVWKQVLSGS, (SEQIDNO:6498); XM_005624443.2, CNTNAP1, Del, C_7, PSVPTTALMSPSTSGPRPPQGSSWRIWGALTASGADLMCGWNSTHLGMWSSPSMW GTEMRT, (SEQIDNO:6500); XM_005621271.2, RNF40, Del, C_7, PSVSQLWLLW, (SEQIDNO:6501); XM_014115482.1, DTNA, Del, C_7, PSVWSGCPFCIDWQMWKMSSIRLNVLTATVRV, (SEQIDNO:6502); XM_538279.5, BEST3, Ins, C_7, PSWGPGAPGDSSQRPKEHPHACLWRRPKR, (SEQIDNO:6503); XM_845621.5, MLLT6, Ins, C_7, PTAACRGPGSSLARQQHESHGRGGSSRSSSSSRRTSSPHGPDQPLPQPGGGGWQWPQ RRDR, (SEQIDNO:6506); XM_014122449.1, LOC106560163, Del, C_7, PTAAPPRSEAPRRGHAPSLQRGPAPRTPALD, (SEQIDNO:6507); XM_005623133.1, CTIF, Ins, C_7, PTAERQQRQLSGHAGHGYLGCQHL, (SEQIDNO:6509); XM_014111758.1, RASGRF2, Ins, C_7, PTAGCVQDVLPSEGQKAVLDFSIELKDRSVGPDHLFSIQ, (SEQIDNO:6510); XM_845641.5, EPN1, Ins, C_7, PTAHTEDTRVIPGA, (SEQIDNO:6512); XM_005629454.1, TMEM192, Del, C_7, PTAILTGLLTGVPWISPRVLKMTPFWIPTISHIIHYMLILDPDSILFLRSS, (SEQIDNO:6513); NM_001006650.1, PKD1, Del, C_7, PTALRSSWQRRKPERSRGCMGC, (SEQIDNO:6515); NM_001313776.1, CKM, Del, C_7, PTAPGASAGQWRNSP, (SEQIDNO:6517); XM_014121251.1, LDLRAD3, Del, C_7, PTAPRALGTRSLARPLPAY, (SEQIDNO:6518); XM_014107094.1, HSPG2, Del, C_7, PTARCTAPGYGFPRSHQLILENTYAEWRTRQAPRRPPSSSLSSTAPTRALATP, (SEQIDNO:6519); XM_005636665.1, PAPSS2, Del, C_7, PTASWRPRPGRC, (SEQIDNO:6520); XM_014116196.1, HGS, Ins, C_7, PTATPCGPAAACAGPSCTGQRGPAHLV, (SEQIDNO:6521); XM_014121026.1, SPDYC, Ins, C_7, PTATRARHLHSLYPPEASTMPWAL, (SEQIDNO:6522); XM_005633017.1, KDM4B, Ins, C_7, PTATSQRRAPRGTWRGARAGL, (SEQIDNO:6523); XM_014122125.1, KDM4B, Ins, C_7, PTATSQRRAPRGTWRGARGEAAPHHPHAVRGAAAQHGV, (SEQIDNO:6524); XM_005633018.1, KDM4B, Ins, C_7, PTATSQRRAPRGTWRGARG1, (SEQIDNO:6525); XM_005616892.2, LOC102155339, Del, C_7, PTATTACV, (SEQIDNO:6526); XM_541885.4, BSN, Ins, C_7, PTAVCGQPAAAWAGGAHRCPCHQGQPAPGAGPGPAAGGA, (SEQIDNO:6527); XM_014113859.1, SLC22A31, Del, C_7, PTAWYSPRQLASSRCWALCCCRA, (SEQIDNO:6528); XM_014106909.1, NCOA6, Del, C_7, PTCRPCRATVPRETTSQAMGCLSMHLSVEHPMEIRCPVVRIQAFQSIRMSH, (SEQIDNO:6530); XM_014117984.1, LOC102154618, Ins, C_7, PTCYCRGTQTAPRPLDQQCLSDPLSEPTAEPYQNFI, (SEQIDNO:6531); XM_014116531.1, LOC106559282, Ins, C_7, PTDHRETPTSALLPGPQV, (SEQIDNO:6532); XM_859725.4, WAP1, Del, C_7, PTENMKQVSK, (SEQIDNO:6534); XM_014116271.1, UBE2O, Del, C_7, PTFATSPSAVAA, (SEQIDNO:6535); XM_005626805.1, CCIN, Ins, C_7, PTGGTGLSCLLSSQATVQDSSKDL, (SEQIDNO:6538); XM_538856.5, RXRB, Del, C_7, PTGLPLPSHQLFHGVPWFAPSSSPRILRACQQSPD, (SEQIDNO:6539); XM_005631571.2, C18H11orf84, Del, C_7, PTGLWFCQSPAPPWGGSQRQGVAC, (SEQIDNO:6540); XM_542234.5, MAML2, Ins, C_7, PTGPCCPPDGLPSSRRHSPTAPARLSPSPPAAPAQQWQ, (SEQIDNO:6541); XM_005628076.2, LOC102156955, Del, C_7, PTGPGLPVRCPHCSCNPLCSVIFCQMI, (SEQIDNO:6542); XM_014114179.1, DTX2, Del, C_7, PTGPPLSLGPTRPLLHTASPPSLGLGLHPG, (SEQIDNO:6543); XM_536750.5, CDH15, Del, C_7, PTGPPSTFS, (SEQIDNO:6544); XM_005626257.1, LOC102155231, Del, C_7, PTGSASRLWTPVGVDPAAATTGALLLPGLRPELFPRVPPTLQNGMVRPSAVTVGRQS WL, (SEQIDNO:6545); XM_014111179.1, SOX13, Ins, C-7, PTGWPAANELL, (SEQIDNO:6546); XM_014115709.1, CCNK, Del, C_7, PTHPLPQCPLHQPPSPLLPFLPPLLAIPLLPPPTTPTSHPHPHACPPPTQCPLTLLQAWA CHRPATPLRLSPLEDSHPCPHPSPHPVCLQLGGWGGQPG, (SEQIDNO:6547); XM_014112099.1, LOC106558522, Del, C_7, PTHRGAEYQP, (SEQIDNO:6548); XM_005635892.1, DMTN, Ins, C_7, PTIPRGVGGEPVPWNHLSGFSPKNHRDPPDQPTPFPPS, (SEQIDNO:6550); XM_532087.5, NELFE, Ins, C_7, PTKPQPGPQS, (SEQIDNO:6551); XM_546651.5, MAPK7, Ins, C_7, PTKTSRLPHWSCTAACLPSPWACSSPRQPSGACPWPSSTPDCHP, (SEQIDNO:6552); XM_014114822.1, BCAR3, Del, C_7, PTKYQSHYCCLL, (SEQIDNO:6553); XM_014111054.1, CNPPD1, Del, C_7, PTLDWSPGASWNPAYLLLCHSACRVPLMSPAA, (SEQIDNO:6554); XM_014111411.1, LOC611589, Del, C_7, PTLHLILK, (SEQIDNO:6557); XM_005631547.2, KCNK4, Del, C_7, PTLPGSPCGRGRKADRC, (SEQIDNO:6559); XM_014122488.1, SOCS6, Ins, C_7, PTLTVATSNADQSNPKELQWAHRHRCPRG, (SEQIDNO:6560); XM_005616531.1, CIC, Del, C_7, PTLWGWWNLERVPLPPLRRMPLALQESPGWTVRQRVTTMMPSSPSCLLRSSCPCHP GNAGPSLSVPCQRNETPLQRRMDAAPTSGRRTISGGP, (SEQIDNO:6561); XM_847197.3, SCAND1, Ins, C_7, PTLWRLPTRPGDIPPAFPAVPLPGRRRSAGGVPAAAGALPPVAATRHPHEGADRGDA GAGAAAGHPA, (SEQIDNO:6562); XM_014117185.1, INHBE, Del, C_7, PTMLQPSSTLCSSPTGLWAAST- GRVRR, (SEQ ID NO:6563); XM_014117000.1, HMCN2, Ins, C_7, PTNHRSELGAGHCYRQQQCLPVL, (SEQ ID NO:6565); XM_005630633.2, HIPK1, Ins, C_7, PTPAATRTGRWS, (SEQ ID NO:6566); XM_548413.5, ABL1, Ins, C_7, PTPAGEKD, (SEQ ID NO:6567); XM_005627318.2, FOXP4, Del, C_7, PTPALRGLLKTGTLRRSCQERNCP, (SEQ ID NO:6568); XM_005632724.2, GTPBP3, Del, C_7, PTPARAAW, (SEQ ID NO:6569); XM_014118742.1, SCRIB, Ins, C_7, PTPCHSPQHRGHCQPWRVWAAQAGS, (SEQ ID NO:6571); XM_005626251.1, ANTXR1, Ins, C_7, PTPCTPLPSPTPQCSHPSDSIPTVHPSPSPSRPTSQQGATPLPTSSQAFCL, (SEQ ID NO:6572); NM_001003291.1, ICAM1, Ins, C_7, PTPCYPPDCGSGHTVVCGLHSGWGVPSFGGPSPPGVSRREAALHSPVQKGLPLGHG KCQSKPRRRGYPAAMV, (SEQ ID NO:6573); XM_005638154.2, E2F5, Del, C_7, PTPFLKNRLQILWL, (SEQ ID NO:6574); XM_014115723.1, ADSSL1, Ins, C_7, PTPFVLPVCPPQGARRVHRHSPRACGHFDSNTGGAREPGPAGHGAPGETTVPPHPLS ATMELGWWGPGLVLPGRVGPHSCIRGGTSRAARRIGAGPG, (SEQ ID NO:6575); XM_014122165.1, CBARP, Del, C_7, PTPFWPAPPAHPPLSAG, (SEQ ID NO:6576); XM_849945.3, PGLYRP1, Ins, C_7, PTPGPQGGPESAGLWCGSGKTEPQIPAQRTPGCAADTLSRRPTL, (SEQ ID NO:6578); XM_005628972.2, GJA4, Ins, C_7, PTPGRLLRALCRPGLLLPAHGRGTLVPAVPHLQRALLQRAELGQPDYGGEAGFLQG PPLPGPTPREWPEIPQSPQQLCFQEAVCV, (SEQ ID NO:6579); XM_861377.4, COX11, Ins, C_7, PTPGRYGRALASPVETRCLLWLALEPPWLRGQGRGEGRAPSQAGNEWGRRC, (SEQ ID NO:6580); XM_014112341.1, ADAMTS7, Del, C_7, PTPHHGPHQLRTGQPMAESPRPSLWTPARPRTPHPPRMPAGRWGAGVSAPPPAAWV LSGGPSAAAPAAKRTVPPPAAPSLPAAAT, (SEQ ID NO:6581); XM_014112562.1, FAM193A, Ins, C_7, PTPHHRWLHQRSTQRLQRPRL, (SEQ ID NO:6582); XM_846233.4, PPFIA1, Ins, C_7, PTPHICAHGPLPSAQWALHPTKGPAQPSQGGGQTGGHDSIAGFPGRGTR, (SEQ ID NO:6583); XM_005631375.2, PPFIA1, Ins, C_7, PTPHICAHGPLPSAQWALHPTKGPAQPSQGGGQTGGHDST, (SEQ ID NO:6584); NM_001006645.2, KCNA5, Del, C_7, PTPLGPPGGPTAARPWRPPRAPRWRLSCRGPWLTPSSS, (SEQ ID NO:6585); XM_014116624.1, HOXB3, Ins, C_7, PTPLPGRHAPGGRLPALGVLAAVPGQRRPAGQEQGAQR, (SEQ ID NO:6586); XM_005616581.2, DYRK1B, Ins, C_7, PTPMPWSSPITNL TTTPGADGCEPGGRPFRLLPTSPSACPPAPGCLSPPDSDDRRSSTPPTP, (SEQ ID NO:6587); XM_005628310.2, OPLAH, Del, C_7, PTPPHCSRRVLSFCLSNSSRGVSSRRMR, (SEQ ID NO:6588); XM_003639335.2, LMF2, Del, C_7, PTPPLWPRRRSTGQPLRRTAGLPAKRPPPPLTTAAAALRLLGGKS, (SEQ ID NO:6589); XM_005639705.2, IRX1, Ins, C_7, PTPPQGAHLSPNALLLPLPRRERPRPPAGLARTAVKIALPARARQLAGPAGGDAADP SSPPVGL, (SEQ ID NO:6590); XM_005624035.2, LOC483345, Ins, C_7, PTPPRKGHGPPTGPLDVSAGGWDSRCERWGHAAGQWGHRQRGPRGDLLQWPVGD RV, (SEQ ID NO:6591); XM_014109382.1, IGDCC4, Del, C_7, PTPPRSLATNSTGGRWGPRRRLVVRVPQGATETRPGMWGLSGSRRK, (SEQ ID NO:6592); XM_003639759.3, RBM15B, Ins, C_7, PTPPVLRPGPDLFGRGLDQP, (SEQ ID NO:6593); XM_014114445.1, LOC102155512, Ins, C_7, PTPRGGEGSAAPCPPCVPWACTLGPPHTRRGDCVPTRGLFRVSQQAARLLGSV, (SEQ ID NO:6596); XM_541589.4, CIC, Ins, C_7, PTPRPLHSCHRQV, (SEQ ID NO:6597); XM_005621172.2, MICALL2, Del, C_7, PTPRSAWAQRLQAQQTPQTGPHQQPPRCSRPGRGSSRLLELPPALAQLAGPRLLQMC LLGLTAGSRR, (SEQ ID NO:6599); XM_014117413.1, TLE1, Del, C_7, PTPSSDPASPATHARSTP, (SEQ ID NO:6600); XM_005620885.2, NECAB2, Del, C_7, PTPSWEPWNQGRVLHLSSWTLRRRAWRPRSAAWQS, (SEQ ID NO:6601); XM_537553.5, EV1, Ins, C_7, PTPTPTASRRSTGCQP, (SEQ ID NO:6603); XM_005626204.2, SBF1, Del, C_7, PTPTPWTMQISILSSLRPVAPF, (SEQ ID NO:6604); XM_005625442.1, PRDM12, Ins, C_7, PTPVSNRKAYSGQPTASEDFGPKPPESGEPVAHDAVAGRAQPQCWPLPCPPPGQEFH APRRAASGTVERPV, (SEQ ID NO:6606); XM_545880.5, IL16, Del, C_7, PTPWSSSSQSQSHCRGAPSPPPRPASWECRGPLSQDGSPVGRPSSPTLILSQGCCPHTQ RKPRAPLSRCRANGRGASPCPAPSPGR, (SEQ ID NO:6607); XM_536901.5, BCL7C, Ins, C_7, PTQAHLPKCPRPL, (SEQ ID NO:6608); XM_014106943.1, RIN2, Ins, C_7, PTQAPATRY, (SEQ ID NO:6609); XM_847374.4, HOXD1, Del, C_7, PTQEPVPPSLERTRGALLRPRSPH, (SEQ ID NO:6610); XM_534998.5, PPRC1, Ins, C_7, PTQEVAKIQLQFLWTFPKMLFLFFLLIFFLFFLIFVIQFSKPVPLPIPPTEK, (SEQ ID NO:6611); XM_542667.4, IRS2, Del, C_7, PTQQCLRPAGPVAAALAAPTAS, (SEQ ID NO:6613); XM_014117450.1, LOC106559402, Ins, C_7, PTQQGPPHGPAGPPQLHCPAGPPPPPAGTQRLRRGRAVWA, (SEQ ID NO:6614); XM_005636739.2, ITGA5, Del, C_7, PTQRAWSWIRRVPSTTGYKDGKRQAGARAPRDLRS, (SEQ ID NO:6615); XM_844090.4, INO80, Del, C_7, PTRAAVICWSLWMTQPPQPPSLGPPTLLLP, (SEQ ID NO:6616); NM_001048083.1, ARSA, Del, C_7, PTRASTGSWASRTRTTRALART, (SEQ ID NO:6617); XM_014115355.1, TRIM46, Del, C_7, PTRHLPGTTPSSSGVPMCLPSQAPPAGSGGKR, (SEQ ID NO:6618); XM_005631210.2, LRRC55, Del, C_7, PTRPCCWSPSSWQPG, (SEQ ID NO:6619); XM_014116949.1, KCNT1, Del, C_7, PTRPTSAAPLPYATCCL, (SEQ ID NO:6620); XM_014122642.1, FAT3, Del, C_7, PTRSPTTRIWWARPPPVSLVLLP, (SEQ ID NO:6621); XM_005638950.2, SIK1, Del, C_7, PTSCTPAAPRWHRRPGCWTPTCTSATPWPPVPPPRCPPALWPRGSRRGTVRWRT, (SEQ ID NO:6622); NM_001286964.1, UBE2S, Del, C_7, PTSFAWCIRR, (SEQ ID NO:6623); XM_849543.1, GPR152, Ins, C_7, PTSGPCSPAPAGFCGSPTVRFWGPASAELLRPATGEP, (SEQ ID NO:6624); XM_014114351.1, STX1B, Ins, C_7, PTSHQRLRPGHHPHLGPAPLG, (SEQ ID NO:6625); XM_005633459.2, MYO7A, Del, C_7, PTSLPLPIIAIST, (SEQ ID NO:6626); NM_001110767.1, MYH9, Del, C_7, PTSMPSQTPPTGV, (SEQ ID NO:6627); XM_014115267.1, ENAH, Ins, C_7, PTSPSASRSPPPCIWIFCGIRVRRQSPFDWTCGCHRRSETEESVPDGGCLFPRRRCEPSL I, (SEQ ID NO:6629); XM_005631005.2, ABCA13, Del, C_7, PTSPTPSEPASCTA, (SEQ ID NO:6630); NM_001003247.1, KCNB2, Del, C_7, PTSQGPTSTKEPGGPRS, (SEQ ID NO:6631); XM_545805.5, GABRA5, Del, C_7, PTSQRNRPQQ, (SEQ ID NO:6632); XM_536455.5, CYFIP2, Del, C_7, PTSRPSADSWVTRASQWSWRNC, (SEQ ID NO:6633); XM_537251.5, ASHIL, Ins, C_7, PTSSSFLYACWPFTSQSNQIP, (SEQ ID NO:6634); XM_014121822.1, MYO1F, Del, C_7, PTSSSWSCSLWRESCTWET- SASAKMGITPGWRVWTCWPSPPTCWAS-TAHGCRRSSP AARWTVAGADAVSPSM, (SEQIDNO:6635); XM_005626284.2, FLT4, Del, C_7, PTSTRRRLPPPAPTVARPSPALPTGCP-PLSVSSGTGGHGHPARPSPSAASAGGSRE TTCH-SARTGER, (SEQIDNO:6637); XM_852991.4, DLL4, Del, C_7, PTSWAPTVRRK, (SEQIDNO:6638); XM_541409.5, ZNF628, Ins, C_7, PTTAPALGQPPGLCLPPMREVLPDS-GRPLPPPAQPRGGRRAGVPLWQL, (SEQIDNO:6639); XM_005631742.2, SHANK2, Ins, C_7, PTTAR-QCPACHQGDTTKDLQAVGGRLRGQEPD-SLRPKGKRYQ, (SEQIDNO:6640); XM_014122450.1, LOC106560164, Del, C_7, PTTFILSSKN, (SEQIDNO:6641); XM_014117663.1, AKAP2, Del, C_7, PTTGSRPTAPRFWITMWPERSAT, (SEQIDNO:6642); XM_014111656.1, HDAC6, Del, C_7, PTTPASPRSE-VLRRVPYATPALV, (SEQIDNO:6643); XM_005616464.2, CBLC, Ins, C_7, PTTPSAECVRS, (SEQIDNO:6644); XM_014110091.1, MINA, Del, C_7, PTTRETE-QSFQRQVDGCQGWTAR, (SEQIDNO:6645); XM_014110676.1, CSRNP3, Del, C_7, PTTRPPAPRSS-CAARRPTTAACPAPACTPTAGPATRRWNSTRT, (SEQIDNO:6646); XM_005622745.2, TRIM46, Ins, C_7, PTISFPLPACASLLCVSCAPDRDGCEER-DQDKHEEHGKGASVPSVSRDVQAATGAAL YSQRVPGLCPGGAGPARLYRPLWGPQL, (SEQIDNO:6647); XM_005623336.2, PAX9, Del, C_7, PTTVTFP-PRWRSRECRQPEKVVTLSRLLRS, (SEQIDNO:6648); XM_854614.4, MBD6, Ins, C_7, PTVPPTF-STPYPHSFKFCAAGCQPGSPLGDAPPAL-CPECPPTWTIYLQCHHGNY, (SEQIDNO:6649); XM_536899.5, MYLPF, Del, C_7, PTWEATWT-TRTFATSSRMATPRTRS, (SEQIDNO:6651); XM_014119360.1, CCDC9, Ins, C_7, PTWRPGRHGPGSPQLGGQLRGAASRRSWGPWPER-PGPRVPSSFWSWRYLSG, (SEQIDNO:6653); XM_014122137.1, CPAMD8, Del, C_7, PTWSAGSR-PRSRSASTITWAPVPRCT, (SEQIDNO:6654); XM_005637420.1, LOC609303, Del, C_7, PTWVGSGGSSLARTGKSGLPL, (SEQIDNO:6655); XM_014110880.1, MYO3B, Del, C_7, PTYLHQQMLLTNVWLLSAKTSALSSVEKVAL-GRQRVPT, (SEQIDNO:6656); XM_014121010.1, MAP3K11, Del, C_7, PTYWSTGL-CRLPVGCITCTVRPWCLSSTETSSPTTFCCCSPLKVM-TWTIRP, (SEQIDNO:6657); NM_001136500.1, SLC6A3, Ins, C_7, PVAAHLLPGAGHHPALL, (SEQIDNO:6658); XM_014116209.1, LOC483316, Del, C_7, PVAGPCHCTPGTPGRIWLAVTSCWIS, (SEQIDNO:6659); XM_014116591.1, NOVA2, Ins, C_7, PVARPVPGLGLVFHRQHPHTLPRQCQHHT-PAASHLCGTHRHFWSQPANQSGPTPG, (SEQIDNO:6660); XM_014113331.1, ROBO3, Del, C_7, PVATRSLPCPGRRTVQDSERRREGSRFVEGS, (SEQIDNO:6661); XM_543631.5, CALCOCO1, Ins, C_7, PVEGVPYL, (SEQIDNO:6662); XM_847901.4, HNF1B, Ins, C_7, PVFPYLPVSICDGGHGYQQHQYAYQHVFQ, (SEQIDNO:6663); XM_014112907.1, SEC24C, Ins, C_7, PVFSTGSYWQTCRCL, (SEQIDNO:6664); XM_014107178.1, ZNF512B, Del, C_7, PVGMTGPQE-AETRGRGAPLAGRREPARLLRS, (SEQIDNO:6665); XM_014107177.1, ZNF512B, Del, C_7, PVGMTGPQE-AETRGRGAPLAGRREPARLLR-SPRLGGSLVTRGSGLMRAP, (SEQIDNO:6666); XM_846062.3, DDN, Del, C_7, PVGPARNLGAAL-GWPSQ, (SEQIDNO:6668); XM_005640123.2, BTN1A1, Del, C_7, PVGWGFSWTMNQETSPSTI, (SEQIDNO:6669); XM_848566.4, SLAIN2, Ins, C_7, PVHPGVRGGGPPRLSLGAGRQSRGGGRVGPPGD-EQRPTSGSPLPAGGGRGRLA, (SEQIDNO:6671); XM_005620294.2, IGSF9B, Ins, C_7, PVHRGQGGWQCDHDLHSFWEPQAHCHLAQGGDT-PRC, (SEQIDNO:6672); XM_014116201.1, LOC106559219, Ins, C_7, PVHRGSGPVPGIPGPAPCAL-SPHPGNCLPGPLGGFRSHL, (SEQIDNO:6673); XM_014108388.1, MICAL3, Ins, C_7, PVH-WHEETADTRAWGQPAVLLPT, (SEQIDNO:6674); XM_014108390.1, MICAL3, Ins, C_7, PVHWHEETGLD-KEGVPTELRRQRHVLFLPEAGLRDGKAEC, (SEQIDNO:6675); XM_005639159.2, AFF1, Ins, C_7, PVICTFQPASSSPDTRKQQDSQQ, (SEQIDNO:6676); XM_005623824.2, LOC102153127, Del, C_7, PVIPP-PASATVLGGP, (SEQIDNO:6677); XM_014113682.1, PTPRK, Del, C_7, PVLALSWCIAVLVLDGLAVTS, (SEQIDNO:6678); XM_546606.6, PERI, Del, C_7, PVLRGVPRRGALGVVLGPRLPVRRLLSQRPDWWR, (SEQIDNO:6680); XM_540461.5, TMC8, Del, C_7, PVLRSTSPSSGALS, (SEQIDNO:6681); XM_014109253.1, PCMTD1, Del, C_7, PVLSGNRTWLVFIFDVHLEIS, (SEQIDNO:6682); XM_005617747.2, RPS6KA1, Del, C_7, PVLVPISCSVASASWPLA, (SEQIDNO:6683); NM_001003090.1, COL1A1, Del, C_7, PVLV-VALVMPVLLVPLALLDPLVPPVLPAAVSTSASCP-SHLRRRLTJMAAAATTGPMM PTWSVTVTSR, (SEQIDNO:6684); XM_014114196.1, LOC489893, Del, C_7, PVMERRIAACR, (SEQIDNO:6685); XM_543063.4, FAM210B, Ins, C_7, PVPAAAPARARR-SAAARGPRGQRRPPGPQQNHCDNRQGCQQRTGGK-AKQVTAAEK GLPRVRRRCCVAAHWNLVSLLGHLLHGGFKWCGHVCS-PA, (SEQIDNO:6687); XM_547204.4, LMF1, Ins, C_7, PVPDRSVGLPVADFQNHAWSRPDQDPGRPV-LAGPHLHGLPL, (SEQIDNO:6688); XM_548063.4, ASB16, Del, C_7, PVPGPGSPGHAAAAETQPCTMLCSLVTCNR-SKPCSKMKMLPT, (SEQIDNO:6689); XM_005631208.2, TNKS1BP1, Ins, C_7, PVPGRATGTER-PEQLAWRGWPGGWRAAGEAAGGG-PEPRRCWPGRQGGGPPRLG G, (SEQIDNO:6690); XM_542530.5, NAV2, Ins, C_7, PVPGWHSSAT-GASHSPSPGPASPAGAASAVKSTS, (SEQIDNO:6691); XM_847692.4, FAM214B, Del, C_7, PVPPLFLPLL-SAVPCWATLRNHCCEDALHHLATLRASQQR-LELVDPTAPSMSRCLSL SPSLMFLSKM-PRPPSWVSWT, (SEQIDNO:6693); XM_014107749.1, LOC106557811, Del, C_7, PVPVHRPCLRVVASPSQ, (SEQIDNO:6694); XM_546577.3, BCL6B, Del, C_7, PVQAAQTPRPATGKSTSSSC, (SEQIDNO:6695); XM_014107688.1, KIF1A, Ins, C_7, PVQFSRKGLRLPEQPAVCPPGAPRGRRQRE-GRGEGLPPRGRAGHLSRRRGPRLWL WRPTVRHGQNLL, (SEQIDNO:6696); XM_014107689.1, LOC100855783, Ins, C_7, PVQFSRKGLRLPEQPAVPRPPGAPRGRRQREGRGER-LPPRGRAGHLSRRRGPRLWL WRPTVRHGQNLL, (SEQIDNO:6697); XM_014114089.1, FAM65A, Del, C_7, PVQPVPPHPGWLSQAAGTGRGAAPGGAEAGAAV-AGSERGAQLGQRLVALGLQGH RGGRAGGGW-GAVPDPP, (SEQIDNO:6698); XM_843647.4, PDLIM3, Ins, C_7, PVRCVPDAP, (SEQIDNO:6699); XM_014115482.1, DTNA, Ins, C_7, PVSGLAAPSA, (SEQIDNO:6701); XM_014111820.1, SLITRK2, Ins, C_7, PVSNLPAFPQWKPPDQTVP, (SEQIDNO:6703); XM_005628022.2, GLI4, Del, C_7, PVSRPL- SILHHQGHLDPTTARPGFTCTVVNTGLRMSKPWK, (SEQIDNO:6704); XM_005628021.2, GLI4, Del, C_7, PVSRPLSILHHQGHLDPT-TARPGFTCTVVNTVLTLRCTPSTAAHHRHCRLD, (SEQIDNO:6706); XM_843722.4, MAP3K12, Del, C_7, PVSRTQTVTARNWTTPTVAKPCSLRPPSLH, (SEQIDNO:6707); XM_005625737.2, ZBED4, Del, C_7, PVSYPLKGCSAHPRRTVASASPGSRWNILKN, (SEQIDNO:6708); XM_005619728.2, SIK3, Ins, C_7, PVTAGDHPSTGAR, (SEQIDNO:6709); NM_001003009.2, TPO, Del, C_7, PVTGRPGAGT-PRVVSGVSAQTLRCSGRTERRV, (SEQIDNO:6710); XM_014106929.1, SNPH, Del, C_7, PVTTLGPLLRMG-STVASP, (SEQIDNO:6711); XM_014114029.1, MTSS1L, Ins, C_7, PVVAQRLWLTEVQHVQCPQQW, (SEQIDNO: 6712); XM_542327.5, INPP1L, Del, C_7, PVWER-GAHQMRSLGAHCPLQTFHPHPCQTRPSSCP-PAWILCQGRWSGAAVGVRPV AHHLTRPIQDLHCPQAPHLPALSWGR (SEQIDNO: 6714); XM_014117254.1, NCAPH2, Del, C_7, PVWRRFQDRNARGRVPP-SCRTFTSGTWLPTLTMPTAGGPG-GRARLLQTWRSCTGS M, (SEQIDNO:6715); XM_845091.3, IGFBP4, Del, C_7, PWAAR-SWCGSRAAAVAPLAPWARGCPAGCIPLAAARA-CAATRPGGWRSPCTR (SEQIDNO:6716); XM_846534.4, PRCC, Del, C_7, PWAFPSQRRGRSP, (SEQIDNO:6717); XM_005629174.1, E2F7, Del, C_7, PWAFRAWSCRLPRWARFPCSTLPPCPGRSPLPPAR-SQTRSSSVHARSA, (SEQIDNO:6718); XM_539692.5, E2F7, Del, C_7, PWAFRAWSCRLPRWARFPC-STLPPCPGRSPLPPARSQVRGLCISGCPAWDPRLT-SSSA PQTWLTPSRPRSPPQTRSSSVHARSA, (SEQIDNO:6719); XM_843592.5, CACNAiS, Del, C_7, PWALASSAHTGWPASGWWA, (SEQIDNO:6720); XM_014114909.1, VSIG10L, Del, C_7, PWALGPLLASS-WVPYWAWPS, (SEQIDNO:6721); XM_014116695.1, BZRAP1, Del, C_7, PWARGPRACQRLVGEGGRPLPG-NAPVAGPQNLTWPAASPPSAWKSASNMILRTSRR QAAGASASPAPATSEMGRPGAQPP, (SEQIDNO:6722); XM_005639039.2, C31H21orf58, Del, C_7, PWAST-RPPPCPRGPQSRLGSSSPGPCSLWPPLSSRR-PRPGRPPGDQGGSRRTWWR (SEQIDNO:6723); XM_014119249.1, CSMD2, Del, C_7, PWCWWAPRGGFASQMGRGVAPSPAA, (SEQIDNO: 6725); XM_014107665.1, HDAC4, Del, C_7, PWETRSTWQPSGPWSCPSRTSLPQTWCSCHQALTL-WRATPRPSAATTSPPNVSGT, (SEQIDNO:6726); XM_539847.5, TCAF2, Del, C_7, PWGFTASMPTMIR, (SEQIDNO:6727); XM_014122252.1, ABCA7, Del, C_7, PWGRRMRTWPESGNGWCTGPPRRTCWC, (SEQIDNO:6728); XM_005626210.1, PKDREJ, Del, C_7, PWHCTRIRKDRARSQAPRRKKPKPVTRTQK-TIKIKMPNLSL, (SEQIDNO:6729); XM_014119061.1, IRF5, Del, C_7, PWHPILYPKRMSS-GRPPSSRLWCWALLHQTPACWAPPLATLLAL-GSFSLKSCRACSL GPWLPACPPQANNSCPTC, (SEQIDNO:6730); XM_005641878.2, FGF13, Ins, C_7, PWHTGIHYVTARFHPICGIKEKRVPLSC, (SEQIDNO: 6731); XM_005616269.2, P01D1, Del, C_7, PWIPRR-SPSSSSSWRSIIMWAQHSPCPEHPRHPATPCLSCEP-LESQMRACPSAATSMA LHPTSIPRRPLVLGPSTWVTCSGS, (SEQIDNO:6732); XM_005637886.1, NSMCE4A, Ins, C_7, PWKVDPARA-VHPPPPRPAGDPGTRAWPRCCR, (SEQIDNO:6733); XM_005637634.2, SFXN3, Del, C_7, PWLADLCPLQRWQLPTASTSP, (SEQIDNO:6734); XM_005639752.2, SOX2, Del, C_7, PWLPPPPTPGR-PARPGTSGT, (SEQIDNO:6736); XM_014116209.1, LOC483316, Ins, C-7, PWLVRVTALRGL1AGFGWL, (SEQIDNO:6737); XM_534697.5, WSB2, Del, C_7, PWMTATSTLAP, (SEQIDNO:6738); XM_014122486.1, TENM4, Ins, C_7, PWNPVPDRHRPPTLRLLHGGQLR-CRHGG, (SEQIDNO:6740); XM_005631742.2, SHANK2, Del, C_7, PWNSQIVLIFPTTALLLSPLSRTWSSRRN-TTPPSPPR, (SEQIDNO:6741); XM_846593.4, KLHL38, Ins, C_7, PWQDGRGVARWAALQRP, (SEQIDNO:6746); XM_852173.4, LOC485469, Ins, C_7, PWQVPVPKEGSQ, (SEQIDNO:6747); XM_533370.5, ZNF407, Ins, C_7, PWRGEASLPGL, (SEQIDNO:6748); XM_547389.5, PLXNA2, Ins, C_7, PWRGPVRDGL-CAQRRKPDPPGHGLLH, (SEQIDNO:6749); XM_005622065.1, LOC102151745, Del, C_7, PWRP-STGSCARQLAKSPAHPQRTVAFLPPSVSPPASRNCMS-TLERRSGCCRWCVEGP RLTMGAADPRQKRNRSSAA, (SEQIDNO:6750); XM_014117067.1, RABEPK, Ins, C_7, PWRQPLCSGWPQLFIFTPSW, (SEQIDNO:6751); XM_003433467.3, TARBP2, Del, C_7, PWRR-SPPSPLSSLSAILLAPCRSWWCRRAGGCLSTR, (SEQIDNO:6752); XM_014118654.1, LOC106559636, Del, C_7, PWRSPGSLLPTQGPARGPGPGTRMSPPCP, (SEQIDNO:6753); XM_548447.5, SH2D3C, Del, C_7, PWRTPQQWDPTLLQ, (SEQIDNO:6754); XM_533751.4, LMCD1, Ins, C_7, PWSHPETGSAVHGAHPKREAAS-DRHRGCLLPPTPAHAPAPHLRPGPFSLPWTSGE, (SEQIDNO:6755); XM_005628933.2, ZC3H12A, Del, C_7, PWSPGVGAPPRLPAWSPHPRRRTRRAVT, (SEQIDNO: 6756); XM_014117075.1, DENND1A, Del, C_7, PWSPLLGSERCPWPAQVPGLLRPSRGWP, (SEQIDNO: 6757); XM_541537.5, DHX34, Ins, C_7, PWS-SEMHPLHQHC, (SEQIDNO:6758); XM_014106771.1, XIRP1, Del, C_7, PWTPVWGWGISEARGAPPT-SHRPWKSQCL, (SEQIDNO:6759); XM_541508.4, PLEKHA4, Del, C_7, PWTQLFTKAWRQILC, (SEQIDNO:6760); XM_014108452.1, TNS2, Del, C_7, PWTSCVPSAKPWRRGSVLTHSTWSYCTARGARAS-SASSSPPTCTTARSLQGQTRRW PRLP, (SEQIDNO: 6762); XM_005627762.1, C12H6orf132, Del, C_7, PWTT-SPKTP, (SEQIDNO:6763); XM_014117646.1, LOC106559457, Ins, C_7, PWVAEEPV-VILQGTSWFWQHTTYGQHCLGPR-LYHFTSKASQHTDPVSKRSNAGIAS QPTLEVTVGNSL, (SEQIDNO:6764); XM_014113085.1, SAL13, Del, C_7, PWVLWPPEWTKHALA-VVHPSWVWTKRTPRQEPAGRSHGLLKITRRLALT, (SEQIDNO:6765); XM_005616816.1, LOC102151589, Ins, C_7, PWVPEEPLATLQGASCFWQHTTQ, (SEQIDNO:6766); XM_005616816.1, LOC102151589, Ins, C_7, PWVPEEPMLQGTSRFWQHTTYQQHCLGPR-LYQFPSKVGQHTDPCSDASQPRNRLSA HNWR-SQWATA, (SEQIDNO:6767); XM_005616815.1, LOC102151355, Ins, C_7, PWVPEEPMLQGTSRFWQHT-TYQQHCLGPRLYQFPSKVGQHTDPRS-DASQPRNRLSA HNWRSQWATA, (SEQIDNO:6768); XM_014121804.1, CACNA1A, Del, C_7, PWVWGRSVRPEWLTRGSFAWICLWPTTTPSTSIL-PSWL, (SEQIDNO:6769); XM_014107013.1, PEF1, Ins, C_7, PWWRTVWQWGTPRWWLWRGSCPR-RALWTTSWWGTLWGAPLWNSRRTIWWCGP GGPLWSATSKFLRCPASWALWTGTSSR, (SEQIDNO: 6770); XM_014121664.1, KIAA1257, Del, C_7, PWWWKCMTGTAN, (SEQIDNO:6771); XM_014114672.1, HCFC1R1, Del, C_7, PWYSPHLCPHSGARALSCFSGATLGT, (SEQIDNO:

6772); NM_001097544.1, PAX6, Ins, C_7, PYADPHEQSANGHLGRHFHRTHFPWCVSSSSSWK, (SEQIDNO:6773); XM_854614.4, MBD6, Del, C_7, PYCSPHFQHPLPS, (SEQIDNO:6774); XM_014118768.1, WFS1, Ins, C_7, PYEPLWPTASTTAAPGP-LAAQCHCLGGT-GREGGAPCSGTRRCQCGCPRCSPGPKCSE PGKGGQSR, (SEQIDNO:6775); XM_846855.4, SCAMP3, Del, C_7, PYLLFAQSSPAFSRTSPWRSPKN-FRRLYLPCTISGCAARWPFS, (SEQIDNO:6776); XM_014113546.1, DNAH2, Del, C_7, PYMSNSP-FLRSMRC, (SEQIDNO:6777); NM_001284456.1, CX3CL1, Ins, C_7, PYPHPHHFTHSLREQG, (SEQIDNO:6778); XM_005624035.2, LOC483345, Del, C_7, PYPPQERPWPSHWSSGCVCWWLGLKV, (SEQIDNO:6779); XM_543571.4, LOC486445, Ins, C_7, PYRRRR-PRAPKVRLWTRIPGC (SEQIDNO:6781); XM_005642194.1, AEBP1, Ins, C_7, PYSGLLL-RASQTQETPHGPGDR, (SEQIDNO:6782); XM_005619435.1, LOC610073, Ins, C-7, QAAAASRLP, (SEQIDNO:6783); XM_014119834.1, EPHB6, Ins, C_7, QAALQRGRQVDGSRRGLPLPAGPPAGPRRQGLPSLP, (SEQIDNO:6784); XM_843925.4, DAP, Ins, C_7, QADRVHLRSDRPGRQRLPTSSRPGGSPEAPRLH, (SEQIDNO:6785); XM_005630877.1, LOC102151356, Ins, C_7, QAGLGDCLFERLTLKHD, (SEQIDNO:6786); XM_855303.4, ARHGEF15, Ins, C_7, QAGSRSAL-GRWNPNRGQS, (SEQIDNO:6787); XM_014117194.1, B4GALNT1, Ins, C_7, QAGTAGPRA, (SEQIDNO:6788); XM_005630840.1, LELP1, Ins, C_7, QALCQALSS, (SEQIDNO:6789); XM_538933.4, CRIP3, Ins, C_7, QAQDWPPPGQEKPSPHEDIHWGDFTVPWL, (SEQIDNO:6790); XM_542210.4, GRIN3B, Ins, C_7, QAQRLHHGQVAPRLRSLHRRGL, (SEQIDNO:6791); XM_014116184.1, MTA1, Ins, C_7, QARPREERV-WRARRPDPGQVGPRHQQRLPHHPGQEEL, (SEQIDNO:6792); XM_014117439.1, KCTD17, Ins, C_7, QARVPCAAVPGGGADTDGLHHVRRLAL, (SEQIDNO:6793); XM_014118741.1, SCRIB, Ins, C_7, QARVTGGC, (SEQIDNO:6794); XM_848915.4, C5H16orf70, Ins, C_7, QAWCPPENSRAPL, (SEQIDNO:6795); XM_844279.3, SLITRK5, Ins, C_7, QCCLCRTQPERVSGVKSKTKR, (SEQIDNO:6797); XM_847692.4, FAM214B, Ins, C_7, QCLPCSYPCCQPYPAGQL, (SEQIDNO:6798); XM_014121817.1, LOC106560102, Ins, C_7, QCLRRK-NELFTIYHTSFNGI, (SEQIDNO:6799); XM_548063.4, ASB16, Ins, C_7, QCPGPARQATPLLPRPSRAQCSVLW, (SEQIDNO:6800); XM_846100.3, FAM78B, Ins, C_7, QCTSETQCQRCPGPHVEAQARTTSGCDPS, (SEQIDNO:6801); XM_005617747.2, RPS6KA1, Ins, C_7, QCWCPSAVPWLQLRGHWPDGG, (SEQIDNO:6802); XM_014113682.1, PTPRK, Ins, C_7, QCWPYR-GALQCWCWTDWLLHRDRHHAGHG, (SEQIDNO:6803); XM_005616171.2, TNNT1, Ins, C_7, QDPRRGTCGLR, (SEQIDNO:6804); XM_005620578.2, ZC3H18, Ins, C_7, QEADRQWQRQRQQLQRL, (SEQIDNO:6806); XM_547479.5, GPR161, Ins, C_7, QEKELRDI, (SEQIDNO:6807); XM_005634029.2, MBNL2, Ins, C_7, QELPGGERKSHCLLRFPQG-PLFKRELQVSSSSNTFKNSTRN, (SEQIDNO:6808); XM_005633459.2, MYO7A, Ins, C_7, QEQPRDSVRDQPLCRRRLL, (SEQIDNO:6809); XM_541492.5, PRR12, Ins, C_7, QERAAL-SASPGPAAAASYHPHCATPASCWSLWAGRCAGGG, (SEQIDNO:6810); XM_546816.3, PKD1L2, Ins, C_7, QFIQQCDPQVHSPWGIHCVC, (SEQIDNO:6811); XM_857873.4, PTPRF, Ins, C_7, QGAARGAAGL-PATVPPCR, (SEQIDNO:6812); XM_005624466.2, KCNH4, Ins, C_7, QGLCCLEAP-PASHSPTGNLWTSGPQSPDSGWH, (SEQIDNO:6816); XM_542508.5, GALNT18, Ins, C_7, QGLVEAGELHRPDQEPCPHRLLYRGSAVLPGDWP-TRRRHGGLRRRECRAGDQGMA VWRQRGGPAM-LADCPH, (SEQIDNO:6817); XM_005639618.2, LOC102153772, Ins, C_7, QGPKAAAAARGERAS-RAGGFGPWAAGRRERAALGTASF, (SEQIDNO:6818); XM_005637678.2, WBP1L, Ins, C_7, QGPPGRAEQSLVWAQQKQHETPKHR, (SEQIDNO:6819); XM_014122211.1, REXO1, Ins, C_7, QGPVGHRDQGPWAARLQGGPGH, (SEQIDNO:6820); XM_014117950.1, AKNA, Ins, C_7, QGGQEPRQAASGPCQASDLQVTC, (SEQIDNO:6821); XM_005639813.1, ST6GAL1, Ins, C_7, QGQPGPRQSPGPSQGQVR-GLLPGVEQGQLFQKPHPQATEDLEKLSEHE, (SEQIDNO:6822); XM_005622562.1, RCSD1, Ins, C_7, QGRAGPEW, (SEQIDNO:6823); XM_005620601.1, GPR157, Ins, C_7, QGSCTLQDRRLSGIQTYPR, (SEQIDNO:6824); XM_014120095.1, LOC102155747, Ins, C_7, QGSLGVGLGAGRGHVGRGRSGTPTRAPA-PEPQGGLLLGARK, (SEQIDNO:6825); XM_014116704.1, MTMR4, Ins, C_7, QGTSERGGE-SAGALCSAAG, (SEQIDNO:6826); XM_005634779.2, ISM1, Ins, C_7, QGVGPSSPRPPDF, (SEQIDNO:6827); XM_854764.4, MAP1A, Ins, C_7, QHGGCPFG, (SEQIDNO:6828); XM_005624459.2, STAT3, Ins, C_7, QHL-PRSPRKLDNLISRVTTSDPPTN, (SEQIDNO:6829); XM_861323.3, SRSF10, Ins, C_7, QHLSVRKERGR-RHQV, (SEQIDNO:6830); XM_546506.4, DSCAM11, Ins, C_7, QHPGDEEHHSCRRTGHPHQL, (SEQIDNO:6831); XM_531632.3, NABP2, Ins, C_7, QHPNYPKPAQPHT-CRPSWPLQQPCQ, (SEQIDNO:6833); XM_014108796.1, SORBS1, Ins, C_7, QHPQPAETLT-TAACPCLPGSQIHSQRCAAPQAVASRVHVLPCFLPT-LAPLCGHQDS, (SEQIDNO:6834); XM_014121353.1, RASSF7, Ins, C_7, QHTGPSASGQRRAPRENQPRIPL, (SEQIDNO:6835); XM_014110134.1, ZP1D1, Ins, C_7, QHVWKRRPLCWSHHYSE, (SEQIDNO:6836); XM_014108268.1, GRIN2B, Ins, C_7, QHWHCCH-PRGHFRRGGHQGCPRER, (SEQIDNO:6837); XM_014120153.1, FAT 1, Ins, C_7, QIHHCKSNRENP, (SEQIDNO:6838); XM_003638913.2, PCDH1, Ins, C_7, QIPQQAVTSPPRHLLRHQSGPRAAGPIPAQLL, (SEQIDNO:6839); XM_014108723.1, FAM186B, Ins, C_7, QIYILPSATEPRADAPGQAHYLHEGL, (SEQIDNO:6840); XM_005631571.2, C18H11orf84, Ins, C_7, QLACGSVRVQHHHGGAARGREWHV, (SEQIDNO:6841); XM_005628076.2, LOC102156955, Ins, C_7, QLAQACPSAAPTAPATRFAALFSAR, (SEQIDNO:6843); XM_005616244.2, VSIG10L, Ins, C_7, QLETSRSVSRFKCHGCYPSSQMVFRGLKF, (SEQIDNO:6845); XM_005626204.2, SBF1, Ins, C_7, QLGAPGPAPSRGPGG, (SEQIDNO:6846); XM_014117450.1, LOC106559402, Ins, C_7, QLHCPAGPPPPPPAGTQRLRRGRAVWA, (SEQIDNO:6847); XM_014121831.1, TLE6, Ins, C_7, QLPRGLPGR-ERRAGHRS, (SEQIDNO:6848); XM_532351.5, CYC1, Ins, C_7, QLPVVPPRPPVFPGPHQHPEGLPGI, (SEQIDNO:6849); XM_014122286.1, MAP1S, Ins, C_7, QLPVWGGQPPSRGL, (SEQIDNO:6850); XM_014122103.1, GPR108, Ins, C_7, QLSSPEKQ, (SEQIDNO:6851); XM_005631050.2, DLA-79, Ins, C_7, QNICDPPSH1, (SEQIDNO:6852); XM_005624045.1, DNAH17, Ins, C_7, QPGLQGLPRVHRREPAPRESLPVR- PAPQRRDWLPDSHVREAVPYCPGNAAQRDRLG SGHWRISRGKGESRAGGDPGEGPGDVQHG, (SEQIDNO: 6853); XM_847792.4, IGFBP5, Ins, C_7, QPPGLRAGQRARLRLLHDLRPGR-GAVVRRLHGALRPGAALPPPAGRGEAAARPAAR PRGLPQREELPRASQDRERLP, (SEQIDNO:6855); XM_005620885.2, NECAB2, Ins, C_7, QPQAGSRGTREESSICHPGP, (SEQIDNO:6856); XM_005627318.2, FOXP4, Ins, C_7, QPQHCGAS, (SEQIDNO:6857); XM_005627762.1, C12H6orf132, Ins, C_7, QPRGHGLLSACGLAGSQPDGKASE, (SEQIDNO:6859); NM_001006650.1, PKD1, Ins, C_7, QPRPLHLSRAGLRRELHRPADVYRVPGHLHSHGRDPA, (SEQIDNO:6860); XM_005631547.2, KCNK4, Ins, C_7, QPSPEARAAAGERRTGV, (SEQIDNO:6861); XM_014106880.1, RBBP8NL, Ins, C_7, QPTLRAQPPPGQLPAGLPAPRHGL, (SEQIDNO:6862); XM_005624000.2, GCGR, Ins, C_7, QQAPRPGPARRRRPQQEAAAFQGRRRGGPGPLCRHRPGGHPPWGGRQPLREPAGAP RGPGWGRTQVL, (SEQIDNO:6863); XM_005632456.1, STAB1, Ins, C_7, QQHKAGHLPQGVCLHPRPYWAQRPEERLC, (SEQIDNO:6865); XM_014119462.1, SLFNL1, Ins, C-7, QQHPGAGPAGVPGPGGGHAL, (SEQIDNO:6866); XM_014114822.1, BCAR3, Ins, C_7, QQNISPTTAASCDLNGAPSCHF, (SEQIDNO:6867); XM_014116213.1, SDK2, Ins, C_7, QQPHPWLPGSYSRIFLVCL, (SEQIDNO:6868); XM_005616892.2, LOC102155339, Ins, C_7, QQPLQPVCEPLPCGLSWCSGGGAAPHSLRRGLRV, (SEQIDNO: 6869); XM_014116640.1, FCGBP, Ins, C_7, QQPLRGLCRHLLPGLLRTQRTPAVPRELCRGLPV, (SEQIDNO: 6870); XM_014122285.1, UHRF1, Ins, C_7, QQQQGEGL, (SEQIDNO:6871); XM_005635063.2, LPIN3, Ins, C_7, QQRPVRRGVLTASQRHLPLL, (SEQIDNO:6872); XM_533841.5, PLXNB1, Ins, C_7, QQTIVNRCPCPH, (SEQIDNO:6873); XM_014111404.1, FRMPD3, Ins, C_7, QQWGEKAGDQRGEARGQHGKDGS, (SEQIDNO: 6874); XM_540099.4, SDC1, Ins, C_7, QRDHAAPHHSQGFDRQSHHGPGPCHPPSPQGRAA, (SEQIDNO:6875); XM_005631741.1, KCNQ1, Ins, C_7, QRERGPGGSALQLHQPRALPAQQHPAHLRTANCAPQGSRRGVL, (SEQIDNO:6876); XM_005619042.2, ZSWIM8, Ins, C_7, QRGLQRGCDV, (SEQIDNO:6877); XM_014121822.1, MYO1F, Ins, C_7, QRPAAGPAACGGNPALGKHQLLRRWELRPGGECGPAGLPRLPAGHRQHTAAGEAH QPQDGQSLGRTQ, (SEQIDNO: 6879); XM_003640056.3, RFX7, Ins, C_7, QRPQLGGGSASP-GAWAARDRGQRAATQDQELHLQNCTI, (SEQIDNO: 6880); XM_014113137.1, RPS6KA2, Ins, C_7, QRQCTSSV, (SEQIDNO:6881); XM_014117415.1, SHANK3, Ins, C-7, QRRAALPAALPLHRRAPSGRRRRPHHRPRPAPALPRLCSEAIGERPEPWAFRLHLHPP AHRQAPGPQLAPGPGPGRAGAGSGLPGALPVPHACAQPRR, (SEQIDNO:6882); XM_005636589.2, CLDN5, Ins, C_7, QRRPQIRGCARPAGAADRRR, (SEQIDNO: 6883); XM_005632724.2, GTPBP3, Ins, C_7, QRRQEQPGEPTQPEACVHSVAGAGDHPR-RAGDPRGPGWVPRAAERHGGVAGGRG AGGAG-GRAARPPEAGAG, (SEQIDNO:6884); XM_005628127.1, LOC102154750, Ins, C_7, QRWNSLPILPVQQDGAGRWPPDMVGL, (SEQIDNO:6886); XM_005633023.2, TICAM1, Ins, C_7, QSGADGHPLPRGMH, (SEQIDNO:6887); XM_014116790.1, FAM222B, Ins, C_7, QSLAAWRSEDARLRCPPECDRVYLNYPPFNGGHPAAQPAPG-PEQHRAPDQPVLPDE GRHQHYLSV, (SEQIDNO: 6888); XM_014117011.1, PKN3, Ins, C_7, QSMSPDSSHTPGSCRACLAQ, (SEQIDNO:6889); XM_005636451.2, OSBP2, Ins, C_7, QSQEACPHS, (SEQIDNO:6890); XM_546577.3, BCL6B, Ins, C_7, QSRQPRPQGLQLEKVQVHRAKLSGLPSREPGR-GEEFWSTLPPSPAPQWRRGFQQQW QRQ, (SEQIDNO: 6891); XM_005640730.1, LOC102154007, Ins, C_7, QSSRAVGATPPYPRAARTPPPRRAGLRELPHRPGPR-GLPPLSRAAGTPPPPVVQGRGS HPRHPGP, (SEQIDNO:6892); XM_014118241.1, NOTCH4, Ins, C_7, QTLCPWRPLPEPISWTRDLPVCTWLPG, (SEQIDNO: 6893); XM_003432681.3, KMT2B, Ins, C_7, QTPKGRSLTYSAASCCHLPTRPP, (SEQIDNO:6894); XM_014115762.1, CDH24, Ins, C_7, QVASEPLPVLCGG-NGGARHPGGPAAGPGPRPGGQCPHGI, (SEQIDNO: 6895); XM_005639723.2, BCL6, Ins, C_7, QVHILRLAVPTARGDVPPHRWAHIPRGDGGDPV, (SEQIDNO: 6896); XM_542201.5, PCSK4, Ins, C_7, QVQLLSGT, (SEQIDNO:6897); XM_846419.3, ZNF362, Ins, C_7, QVRARPQKDQGGEPRGAACPRSPLPHPGLRRDCQGGQDIQV, (SEQIDNO:6899); XM_544319.4, PCDH12, Ins, C_7, QVRHQLSQGQCPGLQ, (SEQIDNO:6900); XM_846897.3, TBC1D10C, Ins, C_7, QVSSRLHILPGYPI1, (SEQIDNO:6902); XM_005638951.2, LOC102156742, Ins, C_7, RAAAPGAPPPARWGLWARGAGARCWAGGAWGEEL, (SEQIDNO:6903); XM_005618371.1, MAN2A2, Ins, C_7, RAACHRRPFLLGGGGILRAYSPGGPAI, (SEQIDNO:6904); XM_005629427.2, ACSS3, Ins, C_7, RAAPASSRPHPRLQPSRLLEPLQVFRAGCGLGE, (SEQIDNO:6905); XM_005629401.2, LOC100855618, Ins, C_7, RAAPGPRRPGHELRQRGGA, (SEQIDNO:6906); XM_014115692.1, LOC100687926, Ins, C_7, RAGLRQLLGRGLRCDPSRGPRGSCLHLVAAGPHSAPSR-SAAPIRQQHPSVPSPRLTRP GSGSSARVVGRCIFFKQQQPE, (SEQIDNO:6907); XM_543071.4, NPEP1L, Ins, C_7, RAGRPQPHPRRSHPDHCMGGQRDRL, (SEQIDNO:6908); XM_014117109.1, ESYT1, Ins, C_7, RALPAAPGRPGRCSAP, (SEQIDNO:6909); XM_005625727.2, TTLL8, Ins, C_7, RALPRVPGLTAAQPGLQALPLLLRHGAAGRPLRGPGRRPGR-RHVEPV, (SEQIDNO:6910); XM_014121804.1, CACNA1A, Ins, C_7, RAPAPRLLPGLRLRRGRGPR-GRRRGGAPGRGLRRAAPRATRVLAQDSPGPGPGLRL AFPARPATPQRLLPGRTGQAPRAGLPERPARSLQRD, (SEQIDNO:6911); XM_014119707.1, E2F7, Ins, C_7, RAPQHPGR1, (SEQIDNO:6912); XM_014112944.1, LDB3, Ins, C_7, RAPSVPPGQGHRAAGGALPGQQQDPALRPLQQRHQGPLSGSHGPFLAPGGVQLRLL QDLPGGRVLRGGAEQRLLRALL, (SEQIDNO:6913); XM_540605.4, OR10C10, Ins, C_7, RAPTGLLRHHR-SQYHPALPFCLGYCPHGVSHLSLLYLHPGHNL, (SEQIDNO:6914); XM_014113507.1, ARRB2, Ins, C_7, RAQPTPAPHSPAGPAAEEAGPACPPIFLHNTPEPAL-LCHPAAGPRGHGEGLWSRL, (SEQIDNO:6915); XM_014116870.1, COL5A1, Ins, C_7, RASGAAGSARTS-WREGRDWGRGPDGSPRSPRPPRTLWSSRCRWA-TRASRWNRQPR CRGREG, (SEQIDNO:6918); XM_014109098.1, COL17A1, Ins, C_7, RAS-WSHGTARTSRCPRSCGPSWSPWTARPTRRARTC-WRIVHGQQQLHL, (SEQIDNO:6919); XM_005617936.2, KLHDC7A, Ins, C_7, RATGTRAAGPHPRQLGGPRGRQD, (SEQIDNO:6920); XM_014111810.1, PRICKLE3, Ins, C_7, RATPRTPQPA, (SEQIDNO:6921); XM_014112867.1, COL13A1, Ins, C_7, RATRPPGAEGRKR, (SEQIDNO:6922); XM_849440.4, CYP2R1, Ins, C_7, RAVGAANRQHLLAGGLGRARPRL-HEKAEPGVRRDLQFRSWRYISCGFKWL, (SEQIDNO: 6923); XM_014119446.1, KTI12, Ins, C_7, RAYGSPE-GAL, (SEQIDNO:6925); XM_014121319.1, CDC42BPG, Ins, C_7, RCVYCAAAGRERGRA-GALAAGAGRAAEAAAGLTAKAPSCVHPEGSL, (SEQIDNO:6927); XM_542131.4, ACTL9, Ins, C_7, RDAGAGAHWRPRYGQKEPSEGAPGGAGRCGPER-AALRGLLALPGLRGPLPRGAAP QPAPRGPRGGGG-SAHQTLLRVDRGLHPGLVAGLPVLLGPSGAV, (SEQIDNO:6928); XM_014117695.1, FBN2, Ins, C_7, RDDPTSGRRGLC, (SEQIDNO:6929); XM_003434001.4, COL6A1, Ins, C_7, RDKRHQRLPRPQGRRGRSRRPRR, (SEQIDNO:6930); XM_543112.5, MYT1, Ins, C_7, RDLGHARERAEVPYSGLYGPR-PREQQPQHAQKFVWVSHCCC, (SEQIDNO:6931); XM_005624990.2, CUEDC1, Ins, C_7, RDLGKDFGT, (SEQIDNO:6932); XM_543467.4, RHBDD3, Ins, C_7, RDPAVGSPG, (SEQIDNO:6933); XM_546245.4, FOXI1, Ins, C_7, REAVLASPTRHPMPQQLPLLHDLLCERVE-PSEPPCGNTRTEP, (SEQIDNO:6934); XM_014113173.1, DRD2, Ins, C_7, REDPVQSHTTQPPPADPPRPVP-PRPPQHCRQPRQTREEWACQRPPQDCQDL, (SEQIDNO:6935); XM_544279.5, KLF6, Ins, C_7, REGARRDCGEAR, (SEQIDNO:6936); XM_546181.5, ZMIZ1, Ins, C_7, RETPHAAPPQLYELHETHSVAQ, (SEQIDNO:6938); XM_005622571.1, POGK, Ins, C_7, REVPQWDGNPLPPVRVDDRGLDAGLVGGSVAAE-DGCSTQTAWDADPERLPWPRH, (SEQIDNO:6939); XM_014117695.1, FBN2, Ins, C_7, RFPAEPHWCGLC, (SEQIDNO:6940); XM_005619965.2, ELP5, Ins, C_7, RGACPCSRPATHGASWPRPHGSIEQPGPD, (SEQIDNO:6941); XM_844550.3, ZDHHC23, Ins, C_7, RGAGREPRQGEGGLVRQVPAGATGPRVALPDLRHL-REENGSPLCLDK, (SEQIDNO:6942); XM_005639502.2, ZDHHC23, Ins, C_7, RGAGREPRQGEGGLVRQVPA-GATGPRVALPDLRHLREENGSPLCLLCWRIKSPSNTC PFGLLAHFGVWDHTDLGHHL, (SEQIDNO:6943); XM_003640238.3, IKBKG, Ins, C_7, RGATGLLLPQVPVSGP, (SEQIDNO:6944); XM_005633536.2, ARHGEF17, Ins, C_7, RGCAR-ACGLPCQSPLHTAGPITRGCH, (SEQIDNO:6945); XM_544279.5, KLF6, Ins, C_7, RGCSE-QPRLCLQPGDQQPELRREQRVLRQLRGTFSHH, (SEQIDNO:6946); XM_005630224.2, KIF3C, Ins, C_7, RGE-EQDHEPPFPGL, (SEQIDNO:6947); XM_005623708.1, ISM2, Ins, C_7, RGGVPGAAAGGQGVL, (SEQIDNO:6948); XM_014111262.1, KIRRE1, Ins, C_7, RGHQDRRRPRAPAAGRH-PAQPHLPSLQRQAGRHHHLVPGRDAAGGRRGQHG-TAEG RQERDHRQPAAH, (SEQIDNO:6949); XM_005621779.2, NPRL3, Ins, C_7, RGHRTEPESHP-PIPRSAAAQ, (SEQIDNO:6950); XM_014107131.1, OVOL2, Ins, C_7, RGLPQRRRQQQRRRQQQRG-GAWRRREQLVPARPRARDPRTRRRRGPRRTPGGDAA PGRQVENQVHHRHVQRPSGPQL, (SEQIDNO:6952); XM_005640267.2, XIRP2, Ins, C_7, RGPAAPCP, (SEQIDNO:6955); XM_003431951.3, HIVEP3, Ins, C_7, RGPAWHPQSLRAPSLPGVPEAPRRGAQEGEE-TAEAGQVHMPVLQPALRQAQRAPEA YPLAHGRAALPLRPLRLLLQDQE, (SEQIDNO:6956); XM_849841.4, APOA1BP, Ins, C_7, RGPGHLRTWK, (SEQIDNO:6957); XM_543528.4, SUSD2, Ins, C_7, RGPGL-GALRASQPPVRLRPAVLLHGGRQPAP-DGRLHRRQHPGPRPRLGRAPLPHTTP RARPVPLAL, (SEQIDNO:6958); XM_005626825.1, GRHPR, Ins, C_7, RGPGRARPGCGL, (SEQIDNO:6959); XM_547150.5, SRL, Ins, C_7, RGPGTRANRGGPGRGVL, (SEQIDNO: 6960); XM_014110917.1, LOC106558305, Ins, C_7, RGPRPWFRPTAL, (SEQIDNO:6961); XM_014122283.1, ZSWIM4, Ins, C_7, RGQAEPGLPRGTGGARCRGR-GRARPGPARGAAGPQRQASSRELGLRAG, (SEQIDNO:6962); XM_014107696.1, NEU4, Ins, C_7, RGQAPGALPAF1, (SEQIDNO:6963); XM_537756.4, CPD, Ins, C_7, RGQWSRQQPRP, (SEQIDNO:6964); XM_014111003.1, MAP2, Ins, C_7, RGRAGSRPVHV-GASGCRVWPREGRRPGQRDGDQGEGGQA, (SEQIDNO:6965); XM_014106893.1, MAST4, Ins, C_7, RGRATPVPRPDTC, (SEQIDNO:6966); XM_003639781.3, DCAF15, Ins, C_7, RGRGTSSRAWLCQLHQAVLRAGVQRRDRTGGRVRG, (SEQIDNO:6968); XM_541488.5, PNKP, Ins, C_7, RGSP-PHLPALGRASPCPGPGTLDPGYRPE-VLQKPSGAGRKPQDQDRGSETAGN, (SEQIDNO: 6969); XM_005620790.2, CDH3, Ins, C_7, RGYLHHREGNRLVAVE, (SEQIDNO:6970); XM_005639752.2, SOX2, Ins, C_7, RGYLLLPLQGALPGRGPPGHDQHVPPRRR-GAGARRPQQTAHVPALPERPGARHGH, (SEQIDNO: 6971); NM_001122602.1, IGF2R, Ins, C_7, RHCCLPGER-GAGV, (SEQIDNO:6972); XM_014115303.1, PEAR1, Ins, C_7, RHLRSGLLRALLLRQRHRLLAHRRRLRLQGG-LAAW, (SEQIDNO:6973); XM_546739.5, MEGF6, Ins, C_7, RHLWGELWAEVPLSR, (SEQIDNO:6974); XM_543564.4, THAP7, Ins, C_7, RHQPAPAMQEAML, (SEQIDNO:6975); XM_005623942.1, LOC102153864, Ins, C_7, RHRPCRGRGQGWGPGGH-SPRLCAGHVPGQVVL, (SEQIDNO:6976); XM_014112560.1, FAM193A, Ins, C_7, RHWRHPQSPAAPPSGFCSRLSL, (SEQIDNO:6978); XM_005640917.2, SUSD4, Ins, C_7, RIPRLRGHGHGPGGVRTL, (SEQIDNO:6979); XM_849386.2, TMEM119, Ins, C_7, RKPLCLQCRPQGL, (SEQIDNO:6981); XM_014113940.1, VPS9D1, Ins, C_7, RKRAGQQPCGASLTPGAQLHGCTGQRQLL, (SEQIDNO:6982); XM_014118793.1, JRK, Ins, C_7, RLAAGLPPPLQHQRCRLQRGLRLECCARPHLQPR-LEEAVARGHICRRLVF, (SEQIDNO:6983); NM_001313808.1, TRIB1, Ins, C_7, RLA-LQPAAAARRSGSRRRLRERAGAQPHRRL-PAAAAGGARACVPGAVHPHRPRAA LQGVSY, (SEQIDNO:6984); XM_540000.4, LOC482885, Ins, C_7, RLCHARPAQPGGPRRAEHCLPPRELLQ, (SEQIDNO: 6985); NM_001003150.1, MT4, Ins, C_7, RLCQVCPGLHLQRRLGQVQLLCL, (SEQIDNO:6986); XM_014113410.1, ZBTB16, Ins, C_7, RLE-DREDLPLPVLRV, (SEQIDNO:6987); XM_847443.4, GPN2, Ins, C_7, RLGQDHVLPGHE, (SEQIDNO:6988); XM_537807.5, GTF3C5, Ins, C_7, RLGREPDWPEQGPAPPQCHLCQL, (SEQIDNO:6989); XM_014107689.1, LOC100855783, Ins, C_7, RLGSSHAVCSLAGLRAQQEQEKEEDRFHSLQRL-RADLAPPGKSGRELEDGDGGPE PRGHQLRR DAE-HAEVRRPGQADPL, (SEQIDNO:6990); XM_005625428.2, C9H9orf173, Ins, C_7, RLLHEP-LTCVHRLGHLRPLSRSGCLPRGGLL, (SEQIDNO: 6991); XM_846276.4, AKT1S1, Ins, C_7, RLLRAPGL-SPAHTAVCQVPACVRARLGLQGEEARSTVIG, (SEQIDNO:6993); XM_847603.3, LIMK2, Ins, C_7, RLL-SPGRHLLQTGA, (SEQIDNO:6994); XM_531921.4, KDM3B, Ins, C_7, RLLYVFSRSEEQGQPTQLP, (SEQIDNO:6995); XM_014122369.1, FBN3, Ins, C_7, RLPPQWGHPHL, (SEQIDNO:6996); XM_547741.6, LRRC16B, Ins, C_7, RLVLRTREQPAHSQWLLGGSV, (SEQIDNO:6997); XM_014116373.1, LOC490917, Ins, C_7, RMGDAQGRGQRAPLLLQPRHGRDHLGVALRGL, (SEQIDNO:6998); XM_014116734.1, LHX1, Ins, C_7, RNERGGRVV, (SEQIDNO:6999); XM_014106445.1, COL4A2, Ins, C_7, RNHRVSWVHRK, (SEQIDNO:7000); XM_014109869.1, COL18A1, Ins, C_7, RPAAWNPTLSCHRGQGRLGCSRRGLSGAWAC, (SEQIDNO:7001); XM_003434094.4, SIDT1, Ins, C_7, RPAPRPPRPQRGRRFRPRLRRGGEPQHREHLLLDL-PHPTG, (SEQIDNO:7002); XM_014109365.1, CDAN1, Ins, C_7, RPCRDEAFT, (SEQIDNO:7003); XM_005618546.2, LDB2, Ins, C_7, RPGEQQPLEQ, (SEQIDNO:7005); XM_014116364.1, LOC102155336, Ins, C_7, RPGPARGTGSHDGGGLDGPCAGICDL, (SEQIDNO:7006); XM_014112099.1, LOC106558522, Ins, C_7, RPIAVPSTSPRTLVCPWLSWL, (SEQIDNO:7008); XM_542121.5, LRRC8E, Ins, C_7, RPLAAGAPA-GAQPAPLACQAALLAADLPAGPPEGHLRQVRGAPR-RAPVGVWAAWP GGAAPRGALPPGAGSGSGPREPP-GAEAAQGAVSAEQCQQGAGQRD, (SEQIDNO:7009); XM_850276.3, NCCRP1, Ins, C_7, RPLAPGVPRLPPVWPRGALRPLPAQDQEPEGAR-WAAADKGDRLLRVCAVQGV, (SEQIDNO:7010); XM_014118664.1, LOC102154884, Ins, C_7, RPLGAPSGSPG, (SEQIDNO:7011); XM_014121827.1, PTPRS, Ins, C_7, RPLPDVPAGPSLTQELQGED-DHEDVGPAQLGIS, (SEQIDNO:7012); XM_014113968.1, LOC610373, Ins, C_7, RPPCGIIH, (SEQIDNO:7013); XM_014112065.1, LOC491446, Ins, C_7, RPPGQGAADVFHREVRGRERELAAGQRADGRAL-PAVRRLRPRRGQALRVPGPVGQ, (SEQIDNO:7015); XM_014112341.1, ADAMTS7, Ins, C_7, RPPLFPP-CAVQPL, (SEQIDNO:7016); XM_005621491.2, GPRC5B, Ins, C_7, RPPPPAPRLPTRSPFAKGAAPWSAD-KGPWSVAGSGVPARGPGPRATLAAQLRQDGG LVFAAVYQPQK, (SEQIDNO:7017); NM_001031818.1, COL4A4, Ins, C_7, RPPRETWSPWSCRCHRKSC, (SEQIDNO:7018); XM_014112867.1, COL13A1, Ins, C_7, RPPRPPRKVWTGRNEGRRRTHREPRREGGERGDGT-GRRTGRERRARGEG, (SEQIDNO:7019); XM_014112864.1, COL13A1, Ins, C_7, RPPRPPRKVWT-GRNEGRRRTHREPRREGGERGDGT-GRRTGSRRPNWGERRTRWPR ETRSNRIARPYRA-PGNRRERRARGEG, (SEQIDNO:7020); XM_005628301.1, LOC102155929, Ins, C_7, RPPSGSSGQIPAAPRGISPAARPPASPTAGQPRLGPPS-GISAPPAPRSAHQRLRNIGD, (SEQIDNO:7021); XM_005621001.2, COL26A1, Ins, C_7, RPPWPSRQPGLPSKQPPGRPLLPAASDGQGRRRLT-AGFCCCGHSAGRRPRAPGPPRP SRSPWATWSPRT-PRCTRISGPGWRAGHDGTSW, (SEQIDNO:7022); XM_014118255.1, COL9A1, Ins, C_7, RPPWSSRHR-WHRR, (SEQIDNO:7023); XM_014110056.1, LOC102151348, Ins, C_7, RPQGCGENPAPAAPPTTPQ, (SEQIDNO:7024); XM_005622187.2, LGR6, Ins, C_7, RPRALRLPVSDPPLRSAARGPQVGGQPL-CRARGSPLWEPTSLRGWRTAAQGRGSHA RGWGLVSGQGLAARGPSLCLTLI, (SEQIDNO:7025); XM_845916.4, COL3A1, Ins, C_7, RPRGPGGEERR-PRRDGPRWSLRRSWSCRLPRPPWSPRSTR, (SEQIDNO:7026); XM_005633811.2, LOC102152567, Ins, C_7, RPRPAAASRAR-GRRDAGAPQRASGLGPRAAGDARRAEPRQAPPGAE-GSGGRAPGG QRAGDSPWTPSS, (SEQIDNO:7027); XM_014114446.1, MSLN1, Ins, C_7, RPRP-PHHRDPQHHTWGALPSPHLGPALE, (SEQIDNO:7028); XM_005638009.2, CHD7, Ins, C_7, RPSGPPWWQWRQSDGSLPWHAE, (SEQIDNO:7030); XM_014116870.1, COL5A1, Ins, C_7, RPSRLAGSS-WAKRC, (SEQIDNO:7031); XM_005621001.2, COL26A1, Ins, C_7, RPSRSPWATWSPRTPRCTRISGPG-WRAGHDGTSW, (SEQIDNO:7032); XM_014116870.1, COL5A1, Ins, C_7, RPTRPRGISRGERPGWCRWAHRN-PRETWAPRTSRAGWRERSSW, (SEQIDNO:7033); XM_014114191.1, LOC106558877, Ins, C_7, RPVVPSGPDP, (SEQIDNO:7034); XM_014116209.1, LOC483316, Ins, C_7, RPWHPGPLTASRSTSSPH-TTQQELLR, (SEQIDNO:7035); XM_014111054.1, CNPPD1, Ins, C_7, RPWTGLQVPLGTLPTFF-CATVPAASR, (SEQIDNO:7036); XM_014108204.1, CABIN1, Ins, C_7, RQGQVAPPAQHAKAGHPL-GRHQVPP, (SEQIDNO:7037); XM_014110905.1, LOC106558304, Ins, C_7, RQHPGPALLGARGGREGIL-PLQ, (SEQIDNO:7038); XM_005626061.2, FER1L5, Ins, C_7, RQHQAPKA, (SEQIDNO:7039); XM_546894.5, CDH5, Ins, C_7, RRAAHPPAPEERLDLEPDAHR, (SEQIDNO:7041); XM_014116236.1, FAAP100, Ins, C_7, RRAARAGRHLPAPERAHRG-LAAVPALPWPGCTPHAGCQPTGPRLRPCGHLLGSSPR AAR, (SEQIDNO:7042); XM_005640730.1, LOC102154007, Ins, C_7, RRAGLRELPHRPGPRGLP-PLSRAAGTPPPPVVQGRGSHPRHPGP, (SEQIDNO:7043); XM_014122556.1, MICALCL, Ins, C_7, RRAGQV-LARPRATLQG, (SEQIDNO:7044); XM_005618675.2, FGFRL1, Ins, C_7, RRAQALPQTLHGRAHAHAHA-HALTHALARGGQGPPAPAHPLPVL, (SEQIDNO:7045); XM_014107094.1, HSPG2, Ins, C_7, RRGALIP-STACSCSASSSTFFLLLLL-FLLLSFWAFLSRLSVLSLLQRLLSASWEPLLLAA APSLPGEQGGGLWWEAAVYPLLHSSGAGQPAL, (SEQIDNO:7046); XM_536899.5, MYLPF, Ins, C_7, RRGRQRGLQEHLLRHHAWRRQGPGV, (SEQIDNO:7047); XM_005636795.2, LOC486523, Ins, C_7, RRHPGGHRQPESPHSPEPANRPHHPEGEDGGA-RADQDPQQQVRLLHRQGALPGATE QGPGHQVD-SAPGAGHQDREAEPGAPV, (SEQIDNO:7048); XM_005629703.2, PAXIP1, Ins, C_7, RRKA-MLPAHYFCDWICRQ, (SEQIDNO:7049); XM_014119335.1, MYCL, Ins, C_7, RRKRGSPVLPPQTWQF, (SEQIDNO:7050); XM_533193.5, CKAP5, Ins, C_7, RRLFHGHAAQQTL-SAPGVPGAAPALRPGF, (SEQIDNO:7051); XM_005636665.1, PAPSS2, Ins, C_7, RRLHGAQGL-EGADRLLRLPGEARL, (SEQIDNO:7052); XM_014117963.1, TRAF1, Ins, C_7, RRLPGAGRAQGR-PLCRLSPREREERRGPDLPEVGGRPAVWKPGQPAV-AGEGPA, (SEQIDNO:7053); XM_014117413.1, TLE1, Ins, C_7, RRPHRTRHPPPRTPDQH-PEPRGGGVRRDHQQPHEARVHGREGLRQGLGHQP-PRQQE PRLSARLS EQG, (SEQIDNO:7054); XM_014117428.1, LOC476317, Ins, C-7, RRPHRTRHPP-PRTPDQHPEPRGGGVRRDHQQPHEARVHR-REGLRQGLGHQPPRQQE PRLSA, (SEQIDNO:7055); XM_005618001.1, FBXO6, Ins, C_7, RRPPHPL-PARRPGHAVLGGLVRAPRHQQQHRHWP, (SEQIDNO:7056); XM_014114031.1, MTSS1L, Ins, C_7, RRRHAGGHPPRGAAPQDRHQRQVGAPHLV, (SEQIDNO:7057); XM_003434697.2, CMTM3, Ins, C_7, RRRPGARAPRPPARARLPVLAQRPPPAGRVG-PLVHHLCLLCGILGIRLPGSASAGVPP GPLLPIR, (SEQIDNO:7059); XM_014115096.1, PROX1, Ins, C_7, RRRPPPAPAPVASLCHRGLHHVHLPPPLPPSLDG-LPISESIRCSLRLLLGKRQSLS, (SEQIDNO:7060); XM_005630391.1, DUSP2, Ins, C_7, RRRPRLPAAR-PRAPGAPGPRGAGPGRGAGRGQCLGGRAPARRPR-ARAARRAAAEK KNRLTAPRP-PRRRLRRLPGLLSRPVLGVPRPRHVVCRGREQPL, (SEQIDNO:7061); XM_014111178.1, LOC106558357, Ins, C_7, RRRPRTRRDLRDPAAALGPADTPGPPAAAPL-PRTPRPEVAAPRAPSSWETPRLG, (SEQIDNO:7062); XM_003432767.4, FBLN2, Ins, C_7, RRRQDQLPVHAVPGAAPQLH, (SEQIDNO:7063); XM_005633132.2, DAZAP1, Ins, C_7, RRRQWLWTRSEPQRARIPPVPTL, (SEQIDNO:7064); XM_005615500.2, SASH1, Ins, C_7, RRRRAQPAG, (SEQIDNO:7065); XM_014121251.1, LDLRAD3, Ins, C_7, RRRRGPSGPGAWPGRCPRM, (SEQIDNO:7066); XM_005627563.2, LOC102154910, Ins, C_7, RRSPPVSCSVSILSGRVRRRCGGVCRLPTGDLA-SALLHLRKTGRGRMGVLWARRRM ANPGCSS-CRLIPVQACLENL, (SEQIDNO:7068); XM_014114626.1, LOC106558936, Ins, C_7, RRTEPQLAHRV, (SEQIDNO:7069); XM_014117863.1, PAX5, Ins, C_7, RRTGQLLSTDADRDGAWE, (SEQIDNO:7070); XM_532352.5, SHARPIN, Ins, C_7, RSAHTPDPTTQGGSLLEPWRLSGERGAG-GAPGPGHRGRR, (SEQIDNO:7072); XM_846062.3, DDN, Ins, C_7, RSAPPGTSERPSGGPASRAPSSFSTRAP-GAGGATAPSIRAAAERPRGGVGGALGR, (SEQIDNO:7073); XM_014122593.1, MCM10, Ins, C_7, RSCSQS-GEN, (SEQIDNO:7074); XM_845916.4, COL3A1, Ins, C_7, RSGRAPRRSRACGSPRSPGCQR, (SEQIDNO:7075); XM_014110764.1, KCNH7, Ins, C_7, RSIHQDGPKFQSFLTMS, (SEQIDNO:7076); XM_014111149.1, SLC30A10, Ins, C_7, RSPASGPRQWLCGAQRLSPSGHVPK, (SEQIDNO:7077); NM_001197171.1, COL9A3, Ins, C_7, RSPRATWEAGQGWH, (SEQIDNO:7078); NM_001197171.1, COL9A3, Ins, C_7, RSPR-NAGVQGAHRLQRRSRRGRQGRREGRSWPP-WARWRPWLCGAAGASGTPRSA RAG-WAPRGSGSHRIPRAARDPRSPRESG, (SEQIDNO:7079); XM_005631712.2, EPS8L2, Ins, C_7, RSQLPAGSQGLRTRASHGQVCQDPL, (SEQIDNO:7080); XM_005633593.2, COR52H9, Ins, C_7, RSQSY-CLWSED, (SEQIDNO:7081); XM_005633061.2, ANKRD24, Ins, C_7, RSRDPPWPGQSPA-GAAEAGCQGPQCRGGFV, (SEQIDNO:7082); XM_014114089.1, FAM65A, Ins, C_7, RSSRSRPIPAG, (SEQIDNO:7083); XM_014106444.1, COL4A1, Ins, C_7, RSSRYPWVQWNKG, (SEQIDNO:7084); XM_014116484.1, HOXB4, Ins, C_7, RTGAANL-GAGVGCERGGNERSLYRQQESAPL, (SEQIDNO:7085); XM_014106445.1, COL4A2, Ins, C_7, RTGPAWPQRRAWFPRRCRITWTPRLSRPPRT-PRHSRTNRL, (SEQIDNO:7086); XM_014109943.1, COL16A1, Ins, C_7, RTHGTPGLQGKNRTPWPPRTKG, (SEQIDNO:7087); XM_014106445.1, COL4A2, Ins, C_7, RTPRHSRTNRL, (SEQIDNO:7088); XM_539177.5, COL22A1, Ins, C_7, RTRRTPGFTWRDRLPGKTRAPRADGHTWKGWAGW-STRPARTQGPARRQRRRRSA WKTRP, (SEQIDNO:7089); XM_014113529.1, TNK1, Ins, C_7, RTSPCQSCAPGTPRPAIPT-SLCLQPFSAQPAPQGAASLAQKRTPSRSPLGSIWS, (SEQIDNO:7090); NM_001197171.1, COL9A3, Ins, C_7, RTSRTPRSPRGPP, (SEQIDNO:7091); XM_005616826.1, LOC102153346, Ins, C_7, RTSYLPSCI-PAPKAKVSPAHKPDSGSDAERGSPGPHWRAVAGPA-PRWAAGGGPAYP ARSALPIGRAGD, (SEQIDNO:7092); XM_846492.4, XIRP1, Ins, C_7, RTTGGSPSPKREAHSWFPARGP, (SEQIDNO:7093); XM_014112788.1, LSM11, Ins, C_7, RVGG-GRVSLRGSGSSAGRLTPPAPWRSPPDLCRT, (SEQIDNO:7095); XM_005618215.1, LOC102151979, Ins, C_7, RVNVLPPRSLQCTCRPGIGAPSTPSL, (SEQIDNO:7096); NM_001003373.1, C5AR1, Ins, C_7, RVPRLWHCHPGPQHICG, (SEQIDNO:7097); XM_014106638.1, NOD2, Ins, C_7, RVRCPGLCAAAP-PAACGPAAGPQLCW, (SEQIDNO:7099); XM_005625430.2, NPDC1, Ins, C_7, RVVSTGAHFPL-GAPGRAR, (SEQIDNO:7100); NM_001287169.1, SLC7A8, Ins, C_7, RVWPSTPGCHL-LIAPHMGQLCQCAVGHPGSRHFHSWEAP-GPGPDHHHGSCTDLQRR VFLAGAKECI, (SEQIDNO:7101); XM_014121877.1, MAP4, Ins, C_7, RWGGASHPRGSARSWRPHFSQWPQ, (SEQIDNO:7102); XM_547651.5, THOC1, Ins, C_7, RWRKIFKDG-RAYIKH, (SEQIDNO:7103); XM_014119467.1, SZT2, Ins, C_8, HAGPTAGPI, (SEQIDNO:7104); XM_014121820.1, LOC106560103, Ins, C_8, HASLRTKARPRLPGGELRACQRGAVRALSSWFVPQ-APSPPGCC1HLREVRGGSWRL AGGECL, (SEQIDNO:7105); XM_014111220.1, ELK4, Ins, C_8, HFLRFPLCAGAPQDPHAAAES, (SEQIDNO:7106); XM_005617844.2, ECE1, Ins, C_8, HGECLLLAHQE, (SEQIDNO:7107); XM_014111008.1, NRP2, Ins, C_8, HHHLLRLRALHQVHLRLRPAGGRLLSALRDLQDRL, (SEQIDNO:7108); XM_014115018.1, PAQR6, Ins, C_8, HLCRPLPAWIMLGQRPHLWAGGAEPQPQLPPLLCA-THRLPLRLSPARAAGPRAL, (SEQIDNO:7109); XM_847877.4, NUTM2F, Ins, C_8, HLEL-GGDTLWGRCVSHTRVPGGLCDGTRRTRLGLWGLP-GRPGNLSARPSGCGSATS GPAKCP-GALRKHRAAAPRGWQGGQRSQQPEHCVVAQGLL, (SEQIDNO:7110); XM_541488.5, PNKP, Ins, C_8, HLPALGRASPCPGPGTLDPGYRPE-VLQKPSGAGRKPQDQDRGSETAGN, (SEQIDNO:7111); XM_014107094.1, HSPG2, Ins, C_8, HPDRVLVPHGGRRADPGSELCGG-WAAPGHHHVVQAWRQPSHPTPGPRLPPAAAPH VCG, (SEQIDNO:7113); XM_014119833.1, TRPV5, Ins, C_8, HPFPVPDHIPQQQPPGLGDPSSQHPGT-CESRAGPWRGGWRGQYLSFM, (SEQIDNO:7114); NM_001284456.1, CX3CL1, Ins, C_8, HPGPLHPDPPY-PRSPYPRPPYPHPHHFTHSLREQG, (SEQIDNO:7115); XM_014118871.1, LOC106559658, Ins, C_8, HPRAYGQGGRSCGPHLGRRPGLRAQRAGDGEPPR-GAGAPLEFILEAEAPALGE, (SEQIDNO:7117); XM_014107629.1, APBB3, Ins, C_8, HPRHGRAE, (SEQIDNO:7118); XM_005619266.1, LARP1, Ins, C_8, HPSLATRDQTGACLARPG, (SEQIDNO:7119); XM_014120689.1, SETDB1, Ins, C_8, HPTCPTCTPSVPTGR, (SEQIDNO:7120); XM_005639705.2, IRX1, Ins, C_8, HSQFWGLI-ALSLSLFLPLFPAPRLSLSSPLGGSVVAGLTV, (SEQIDNO:7121); XM_547217.4, PRR35, Ins, C_8, HTPGPRVLPRPAPWPFRRHRQPASGPHG, (SEQIDNO:7122); XM_005638159.2, ESRP1, Ins, C_8, HYSSTT-SAICAPYEC, (SEQIDNO:7123); XM_014110156.1, PVRL3, Ins, C_8, LASKRPSISD, (SEQIDNO:7124); XM_014117851.1, NPR2, Ins, C_8, LGQSPLCL, (SEQIDNO:7126); XM_014119807.1, ATG9B, Ins, C_8, LLGLPIHPTPGLSDSP-SHTPMPPGPSWAADRPSDPRAGL, (SEQIDNO:7127); XM_539044.5, BACH2, Ins, C_8, LLLLLLLLLGELHEE- AGGQRPGGLPGEGASAGIQEPDGDRGLLPGND, (SEQIDNO:7128); XM_005634149.1, SCN5A, Ins, C_8, LLRQRHQGHQR, (SEQIDNO:7129); XM_014115306.1, NES, Ins, C_8, LPAPATDWEAAGSRGYTG, (SEQIDNO:7130); XM_003434606.2, FOXD3, Ins, C_8, LPDPSTPTFGGLHPFAHT, (SEQIDNO:7131); XM_005617044.1, ZNF438, Ins, C_8, LPGGPFRPELCPLCTDAGQEGRPPPTLGAAAL1, (SEQIDNO:7132); XM_844550.3, ZDHHC23, Ins, C_8, LPPPRRGHCL, (SEQIDNO:7133); XM_014113971.1, RLTPR, Ins, C_8, LPSHRPKRRRPQPL, (SEQIDNO:7134); XM_005616836.2, LOC102154596, Ins, C-8, LRQPELRPQ, (SEQIDNO:7135); XM_862201.3, ZFP64, Ins, C_8, LRVQGTNRDPRRKDIQLLLPRLPLQNCSWHERFGPPSENPHGRQTTQM, (SEQIDNO:7136); XM_538777.4, ZNF462, Ins, C_8, LSRNARGSQNVQVQRLCF, (SEQIDNO:7137); NM_001002994.1, SCN5A, Ins, C_8, LVRQRHQGHQR, (SEQIDNO:7138); XM_005635333.1, NKX2-4, Ins, C_8, PAAAALPAPRGGARVGQGRQAVPERGQHAHARPGRPAAARPDARAGARGALAQP ARAARPGGRPGVPGRCGGGLRRRRAGRQPALRQDVV, (SEQIDNO:7139); XM_544073.5, PXDNL, Ins, C_8, PAAATQAGLHGAGGRGRGHPRRPVHAHAHAVGPVSGPRSGPRGACLEHFSLLRRA AV, (SEQIDNO:7140); XM_014107254.1, GMEB2, Ins, C_8, PAAPRCRPPQQHRAELRHAGLGEEGAGQPQVPDGPLSGAVRPRPGSPRAAV, (SEQIDNO:7141); XM_844462.4, SPATC1L, Del, C_8, PAARPRCASCSSTCCPPSSWATRCCCSAACASSPRTTASRSSPG, (SEQIDNO:7142); XM_005620294.2, IGSF9B, Ins, C_8, PAAVTYFGNTSTCTRERCYT, (SEQIDNO:7143); XM_014111268.1, IGSF9, Ins, C_8, PACHRVAALWIPTSHLHPVRPLLSTHRP, (SEQIDNO:7144); XM_548709.6, DPYSL4, Del, C_8, PADAPTSRLCL, (SEQIDNO:7145); XM_014109693.1, LOC106558086, Del, C_8, PAGAIPPRLRGGGAGRRGAARGPGGRGCPLPRRPHPRRGLWDLLGIPRLPA, (SEQIDNO:7146); XM_014108311.1, LOC106557876, Ins, C_8, PAGARAHRRPPAPGRPPARGIPPARRPPALSPAASRSGARAPTNPREQPV, (SEQIDNO:7147); XM_005616395.2, C5AR2, Ins, C_8, PAGVRGGLRGLGRG, (SEQIDNO:7149); XM_005629436.1, AMDHD1, Ins, C_8, PAGVRPRSPPFSPGWVYKSHRSC, (SEQIDNO:7150); XM_541589.4, CIC, Ins, C_8, PAIPPTPRPLHSCHRQV, (SEQIDNO:7152); XM_014111420.1, GAB3, Ins, C_8, PALLPAPRRLGPRAQGAGPRAPHAAPAPPEAEPPVRAAPGRAARGRGGVQKSLPVR PGQREDPES, (SEQIDNO:7153); XM_014113861.1, ZNF469, Del, C_8, PALPPPTIPH, (SEQIDNO:7154); XM_014111293.1, ARHGEF10L, Del, C_8, PAPIYWFLPPVVCQSRLFPAPKI, (SEQIDNO:7157); XM_003433123.4, ZBTB47, Ins, C_8, PAPLLHHCHFGRQDERQQL, (SEQIDNO:7159); XM_014112554.1, ADD1, Del, C_8, PAPLSSLGKEVDVLKSTCYH, (SEQIDNO:7160); NM_001314087.1, KISS1R, Del, C_8, PAPPAELHGLPGRAPAPAAPGSRASVPRAPWG, (SEQIDNO:7161); XM_005638643.2, LOC102157171, Ins, C_8, PAPPAGAT, (SEQIDNO:7162); XM_014110074.1, LOC106558152, Ins, C_8, PAPPPPPAAPGCPGSDLRLRRETSPGT, (SEQIDNO:7163); XM_014113868.1, PLCH2, Del, C_8, PAPPREGPCAPRDLAPK, (SEQIDNO:7164); XM_539741.5, GAS2L3, Del, C_8, PAPPRPGSFPPRGPPARRPRRCCPASLRAKPNRSL, (SEQIDNO:7165); XM_005629418.2, ARTN, Ins, C_8, PAPRPRSPGAPHRQPAG, (SEQIDNO:7166); XM_546201.4, RBP3, Ins, C_8, PAPRRAISGGGVLPH, (SEQIDNO:7167); XM_847581.4, KIAA1024, Ins, C_8, PAPTAQAAQRQLPGGAGVQPAPLPGIPQSPHEEQPSVHGHAADGAGRGEAGPTLLD HRGVHEERGRQGQADCPGPADARIFKP, (SEQIDNO:7169); XM_014116397.1, LOC106559250, Del, C_8, PAPTRAASPGSWSCWASRTCPRCGRCSPRSSWPCSCSRCWATRSSCC, (SEQIDNO:7170); XM_005616836.2, LOC102154596, Del, C_8, PAPTRAASPVSWSCWASRTCPRCGRCSPRSSWPCSCSRCWATRSSCC, (SEQIDNO:7171); XM_014118914.1, LOC106559676, Ins, C_8, PAPVLWSRRDRPTTTQNCQQSPWAAWSRPWVTAAAWQW, (SEQIDNO:7173); XM_005631207.2, SSRP1, Del, C_8, PAQKTRHQDLMS, (SEQIDNO:7174); NM_001003247.1, KCNB2, Del, C_8, PAQPGRCPSPRRTSPSPPRSSSAPSS, (SEQIDNO:7175); XM_847992.3, NCOR2, Del, C_8, PARAPSRGPWHPPAPVTRPSPAPQQRASHPTTPARTSLRRPPRPRTCIGKRLKVNPFPS RNWSSVLWVTMVAATAPTEWSP, (SEQIDNO:7176); XM_005631925.2, MGAT4D, Ins, C_8, PARGCPARAPAAT, (SEQIDNO:7177); XM_014110917.1, LOC106558305, Del, C_8, PARGSARAPPRPPPVVPPDRA, (SEQIDNO:7178); XM_014119242.1, LOC106559725, Del, C-8, PARGTPSGAGPGSGAPRGRAPGSPGPGGRKLWGVNGKKWVVRALRLPLTSLPK, (SEQIDNO:7179); XM_539055.5, PRDM13, Ins, C_8, PARPVAPPGLRGAGGHQA, (SEQIDNO:7180); XM_014108323.1, CECR6, Del, C_8, PARRDPCSCSRSSTEPPAASWARVWTCSTASPWWS, (SEQIDNO:7181); XM_537035.5, RBM15, Ins, C_8, PASATVAP, (SEQIDNO:7182); XM_845787.4, PARP14, Del, C_8, PASWWFSI, (SEQIDNO:7183); XM_545182.4, ICE1, Ins, C_8, PATLARSFGRYTSKDFATSFSSDSFLSLLTYFSYWPDVPLM, (SEQIDNO:7184); XM_536512.5, PDZD2, Ins, C_8, PATVGLPAFSFRFH, (SEQIDNO:7185); XM_014109665.1, LOC102154979, Ins, C_8, PAVFLAYPQPRYVP, (SEQIDNO:7186); XM_005639783.1, CHRD, Ins, C_8, PAWHGGHCPTHSQ, (SEQIDNO:7187); XM_014112341.1, ADAMTS7, Del, C_8, PAWPHALCSPRPPSRPA, (SEQIDNO:7188); XM_014116554.1, LMTK3, Del, C_8, PCASPASPSRLRWRPRGLPPGPPTPGPQAPWRT, (SEQIDNO:7189); XM_005616067.2, ZSCAN18, Ins, C_8, PCCMWTPCQWEAQWVPGVCGR, (SEQIDNO:7190); XM_547145.5, CDIP1, Ins, C_8, PCECRWHLHVSRFLPSSRPPPTHGLLSTRALPTGAVPWPWGPYCHSPGSFGGCHHGD STTRRDL, (SEQIDNO:7191); XM_014110156.1, PVRL3, Del, C_8, PCFKKTFYIRLNTCLCRLSSKKERLAVSSTLMD, (SEQIDNO:7192); XM_545182.4, ICE1, Del, C_8, PCHPCSLLWSLHLQGLRNQFLL, (SEQIDNO:7193); XM_014111268.1, IGSF9, Del, C_8, PCMSSSGCALDSYFPSSSSSASTLHASTLITWGESGCRRGRLSRLRASGRKTRAGTSA ECSSWTSTALKTTLPTAPGCTSP, (SEQIDNO:7194); XM_014118914.1, LOC106559676, Del, C_8, PCPGAVESQGQTHHDSELSAEPLGSLVETVGHRRSLAVVRALHMAHVAWHLLPL, (SEQIDNO:7195); XM_014113536.1, FXR2, Ins, C_8, PCPPAQHKIQRFIYQLSAKRSRQ, (SEQIDNO:7196); XM_014110306.1, GRIN2C, Del, C_8, PCPPVPATAPGSLGPGGLRGAGAGPWG, (SEQIDNO:7197); XM_005618679.1, IDUA, Del, C_8, PCRTARLTAMTSAGTSSSTWPMWVLSLTGASSRSGPTGCWSSSRPGSQLGKA, (SEQIDNO:7198);

XM_014111420.1, GAB3, Ins, C_8, PCSATRACLRRLWGGCGRAQGSVSGMGR, (SEQIDNO:7199); XM_014106254.1, ATP7B, Del, C_8, PCSLCSLPWGGGWNT, (SEQIDNO:7200); XM_014109665.1, LOC102154979, Del, C_8, PCSLPCLSTAPVRPLS, (SEQIDNO:7201); XM_005642410.1, LOC102155373, Ins, C_8, PCSRGRGCAPATS, (SEQIDNO:7202); XM_014107254.1, GMEB2, Del, C_8, PCSSEMPSSSTTSCRTSACWTW, (SEQIDNO:7203); XM_014119467.1, SZT2, Del, C_8, PCWAHSRPYLTGPALWSYISPSTSYSSGMRSYPWTTGRPSY, (SEQIDNO:7204); XM_014113225.1, PITPNM3, Ins, C_8, PCWGRVRVGLARRCELWRGHAPGWSWGSAARPGRGDRCSTSGAAHHLVDAAICL DGPKCPGRVVLAGSPH, (SEQIDNO:7205); XM_005615988.2, LOC610549, Ins, C_8, PDAQHSTDPSASKACGPTGAQPRCCGSGPTPIQPR, (SEQIDNO:7206); XM_014117113.1, RASSF3, Ins, C_8, PDFWKARSQQQRLHEHASHQQHEHRRGSDRGPAQEVSRDREPCQVCTL, (SEQIDNO:7207); XM_005628809.2, PTPRZ1, Del, C-8, PDPLSPPRRR, (SEQIDNO:7208); XM_849485.4, FAM209B, Ins, C_8, PDPRLWVPQGHLLRLPRSPQRLDWTRRERAEPGGLPVSPPSLHPPWRLLQGDPREPP EPPPEASQWPL, (SEQIDNO:7209); XM_542216.5, PALM, Ins, C_8, PDRGLQGREPGGARGPGQRPPGPRHEEAAL, (SEQIDNO: 7210); XM_849910.2, C20H19orf35, Ins, C_8, PDRPAAPAPAPAQEDA VQDPLPAHAQGPQHQPCPGSGWAASEAFPGVPQCGREPGGQ, (SEQIDNO:7211); XM_538528.5, BMP10, Del, C_8, PDTKPTNAVGFATTPWQSTSHPQSTRSSRPWSTSRIPKRLPRSAVCPPS, (SEQIDNO:7212); XM_014121373.1, LOC106560025, Ins, C_8, PEAAPGLPAGSAGPSPPHPPAAPGLPP, (SEQIDNO:7213); XM_547544.4, GON4L, Ins, C_8, PEAQADQGQYFHGEVACSR, (SEQIDNO:7214); XM_014117151.1, SMARCC2, Del, C_8, PEAWAPLNRLGRQGQPWGHSSSNQLEPPSLGQSHQGFPPLDPMAPHRSPTNKLLPQ, (SEQIDNO:7215); XM_014118099.1, NOL8, Ins, C_8, PEESQSAE, (SEQIDNO:7216); XM_005622105.1, RAB40C, Ins, C_8, PEPASELLEEQLQDLL, (SEQIDNO:7217); XM_014109156.1, LOC491694, Ins, C_8, PEPCAPRGAEPRALSGHRDPPDPVQRVQVRAGARGHLPGRGRGVLGEPARAAGGG APPLRGACGGAARGRVGHRV, (SEQIDNO:7218); XM_855027.4, ATP2A1, Ins, C_8, PEPQGAPHQWLALLPLHGNWGLCGCSHCGSCCLVVHVCR, (SEQIDNO:7219); XM_014119431.1, FAM160A1, Ins, C_8, PEQRPPAQQPSVRNRLRGGTG, (SEQIDNO:7220); XM_849712.3, TMEM200B, Ins, C_8, PERAATRGSRRRPGPRPARAAAAPWTRGHGRRPVRFHLRQHAALREPRPGDATAAP GGAAGPGAPAP, (SEQIDNO:7221); XM_546237.5, SH3PXD2B, Ins, C_8, PERIYHQVGRGAAGEGAAEDGAAQRLLTQTSRHDFANDSSQTHTSSPGWQEVRAQT (SEQIDNO:7222); XM_534537.4, LATS2, Ins, C_8, PESDDTLQKQPQRGPI, (SEQIDNO:7223); XM_005625313.2, DPM2, Del, C-8, PFPAPLDSIP, (SEQIDNO:7224); XM_014111220.1, ELK4, Del, C_8, PFPPFPPLCRSPPGPPRRR, (SEQIDNO:7225); XM_546528.5, SIK2, Ins, C_8, PFQPGPVPEPCPGAYHRRADA VQPLPWPLPRAAAAAPASGPWPPSPSTAATAPTTAPSPAGRGHPGTPPVLLPDLRA VRGSIP, (SEQIDNO:7226); XM_537509.5, YLPM1, Ins, C_8, PFSLLCSTSTCLAPPTIVFSHTSSGITSPWGSTRDTSSVSHSSSSTSLQFSKFTGSRET, (SEQIDNO:

7227); XM_005622233.2, HSD11B1, Del, C_8, PFWGSSWPTTTILRMRNSDQRCSKERK, (SEQIDNO:7228); XM_014114435.1, LOC106558903, Ins, C_8, PGAAPGGAPWRCPLEPWSLQERAGSRNLPRRGGPARPGKGPEPSKARILARAPAAAP SRIWQRKWVEGPVRSLQWEGPSTASPQVSHFGGPF, (SEQIDNO:7229); XM_540337.5, MOV10, Ins, C_8, PGAGGRRWPVPASRARVEERAL, (SEQIDNO:7230); XM_003639336.3, SHISA8, Del, C_8, PGAPPTTQTGSAPTTCPWGQRPPAPSVAPGCRAGAA, (SEQIDNO:7231); XM_855027.4, ATP2A1, Del, C_8, PGAPRSPSSV AGSSSATWQLGAMWVQPLWELLPGGSCMQMTGLVSPTAS, (SEQIDNO:7232); XM_540881.6, NRXN2, Ins, C_8, PGARGPHVL, (SEQIDNO:7234); XM_014120154.1, FAT1, Ins, C_8, PGARPSHLLHSKHSKRLQEQPGPQFLRRICH-PRAPGIQHLQPRVWARTPQGRGRLQR GPEPASPAPFQLPFGQRLHPEAQLGLRL, (SEQIDNO: 7235); XM_003639754.2, LIMD1, Ins, C_8, PGEAALPDPYPRPRAWALSCRIEIRSPHPTSGA, (SEQIDNO:7236); XM_548091.5, STAT5A, Ins, C_8, PGEGHHHQ, (SEQIDNO:7237); XM_014111420.1, GAB3, Ins, C_8, PGEQGPQAPEETTATSPGPEEPVHHPGTRISNQDLHCTVQSNQISLSRKKRY, (SEQIDNO:7238); XM_849688.3, LSMEM1, Ins, C_8, PGGAPGHPRPGTRRPGPVLYGADNCADCQPGAGLLRDFSNSSDWKQDG, (SEQIDNO:7240); XM_005619884.2, LOC100688504, Ins, C_8, PGGAPRGPRAQGGGGQEGGSARRREGAGGPHGATPQGRGAPPAPGGGAPPGRGLL PRPFPAPLHLYLRGHRLLDHLLHLHPPAAGL, (SEQIDNO:7241); XM_541178.5, FNDC1, Ins, C_8, PGGEARPSARSWQLPESPTRPAQTPPPQPCHAKPHRGHPGPGAVHHPRPSRPCLHHP YAVLAPAHDELEIPEPSLAPACQIPHQTRL, (SEQIDNO:7242); XM_536612.5, PELP1, Ins, C_8, PGGGAAGGGEPPSRAAASRAY, (SEQIDNO: 7243); XM_014115530.1, GREBL1, Ins, C_8, PGGKDRLLFTVP, (SEQIDNO:7244); XM_014118662.1, ARHGAP39, Ins, C_8, PGGLQQHGGSRAAGRAG, (SEQIDNO:7245); XM_532205.6, CD109, Ins, C_8, PGHREGGAGQDGSQPLCLCPGSRRSL, (SEQIDNO: 7246); XM_005631865.2, WDR33, Ins, C_8, PGIARASRLTRSAGAAPGLFGASTPGWHARAPWTSGTAEPGKRATSISRANTIPAAE NSSAR, (SEQIDNO:7247); XM_546237.5, SH3PXD2B, Del, C_8, PGKNLSSSRKGSCRRGSGRGWSSSEAPHPNLQA, (SEQIDNO:7248); XM_014111162.1, PADI2, Ins, C_8, PGLFWEPLVPPALRSPTP, (SEQIDNO:7249); XM_846534.4, PRCC, Ins, C_8, PGNCPRCLLHR, (SEQIDNO:7250); XM_544381.4, CCDC113, Ins, C_8, PGNSQREATAADQSDPL, (SEQIDNO:7251); XM_005615289.2, NFATC1, Ins, C-8, PGPAATTV, (SEQIDNO:7252); XM_014120434.1, NFATC1, Ins, C_8, PGPAATTVLQPHPPI, (SEQIDNO:7253); XM_014121843.1, APC2, Ins, C_8, PGPGQRPHRPPGQ, (SEQIDNO:7255); XM_847637.3, RUNX3, Del, C_8, PGPPSPGRRHQRPRELEAGKAGPRAAGKGRDEGSGGPRVGGPRPGTSGQGALRRAW AAQPSR, (SEQIDNO:7256); XM_843722.4, MAP3K12, Ins, C_8, PGPTQRGAGPPQYRGLRL, (SEQIDNO:7257); XM_544403.5, IRX3, Del, C_8, PGQPSRPQPCSSRPPPRPPRLTDSSRRR, (SEQIDNO:7258); XM_014121843.1, APC2, Del, C_8, PGRPPGTGTGRGARAAAGWGWSCPFAGRRAPALSSTAAAPARREGTEGTEGTGRCS LCASRRPPRRPCTASTTTPTRIHPWPWHPRGDRPPSPGP, (SEQIDNO:7259); XM_014110676.1, CSRNP3, Ins, C_8, PGRVRVPVARGRPPPRAPRGEAFESGRQEQ-

TARRVHHVPRGGDGPRV, (SEQIDNO:7260); XM_014113331.1, ROBO3, Ins, C_8, PGSDSGLGG, (SEQIDNO:7261); XM_849833.4, RPS6KA4, Del, C_8, PGSGPWHRTCCSGYFARTPR-SUWVQGPRGHRKSRTTPSSRVWIGPLWLPGKFQPHSDHRSARSWM, (SEQIDNO:7262); XM_843399.4, ADM2, Del, C_8, PGSPQPVPLPAA, (SEQIDNO:7263); XM_014119322.1, MACF1, Ins, C_8, PGSQTAYFSE, (SEQIDNO:7264); XM_014114200.1, SRRT, Del, C_8, PGWAASQRLTWVCHHR, (SEQIDNO:7265); XM_005616351.2, SULT2B1, Ins, C_8, PGWIRAPPPV, (SEQIDNO:7266); XM_005616395.2, C5AR2, Del, C_8, PGWSAWWTTGARPWLRAPWRPPALCAAS-WGRWWSWPAATVPCCAGPPRTAGPW AWPSCWAFLSAGPPTNCWGW, (SEQIDNO:7267); XM_005640282.2, LRP2, Del, C_8, PHAGVCTEEIAILMRMTSPNASVP-VATWENIVK, (SEQIDNO:7268); XM_014114207.1, GIGYF1, Del, C_8, PHCWATWTRSG, (SEQIDNO:7269); XM_005635161.2, STAU1, Ins, C_8, PHEELCDQGVGWGVCGGR, (SEQIDNO:7270); XM_538777.4, ZNF462, Del, C_8, PHHPRHQTSVLSF-TIANTVPTVIGQLWECLSTTRKDTQR, (SEQIDNO:7272); XM_005621273.2, FBRS, Del, C_8, PHHPTIPPCS-PLAPPCPHPHPCCRCQGTLGPQMLTPFLSRT, (SEQIDNO:7273); XM_005639159.2, AFFI, Del, C_8, PHLCHPHPHPPRSQPSLHKRGQGGKLIP-PAKTLPKVPVVARATTKTLPLPSTEK, (SEQIDNO:7274); XM_014119783.1, SSPO, Ins, C_8, PHLCPGRGD-HAGARELLSHLPPSDSGRPAFPGAAYHGD, (SEQIDNO:7276); XM_860394.4, DLGAP4, Del, C_8, PHLHPQPPAPALGWAPTPTMSSGAPGLL, (SEQIDNO:7277); XM_539768.4, FHDCI, Del, C_8, PHLHSPG-GLRPHLPLRDYPQPLT, (SEQIDNO:7278); XM_546606.6, PERI, Del, C_8, PHLPLLPSRLSSSPTLSRCSPLGEAPSLLPLPLQLG-PLQPSLPRS, (SEQIDNO:7279); XM_549021.5, FGDI, Del, C_8, PHLSPFPLHHHAPCLQT-PEWPRAWPPGWKPAPVLQQYPH, (SEQIDNO:7280); XM_540889.5, RCOR2, Del, C_8, PHLSSALLWLP-PATVPAPAHSLHPP, (SEQIDNO:7281); XM_005616609.2, HNRNP1, Del, C_8, PHLTTKGEGW AHQWGVTVGAQVATAPSMGTPHPLPHHPSMAPTP-TALCSWSMAWINLR, (SEQIDNO:7282); XM_005631954.2, R3HDM1, Del, C_8, PHPCPPGNQSLLLAILPQAILSASLCCSSR-DIFSSPHHRCQPVTVLQATITPVNLSIAQSL LSITIHI, (SEQIDNO:7283); XM_005628329.2, LOC102154101, Del, C_8, PHPEEQLGMP, (SEQIDNO:7284); XM_014120825.1, GLI3, Del, C_8, PHPEIRAAIHSPGR-LAGRLREPLGSRRTSATLPQSGKNASK, (SEQIDNO:7285); XM_014118244.1, SYNGAP1, Del, C_8, PHPGCRSLRTASSETPQTT, (SEQIDNO:7286); XM_014110154.1, THEMIS2, Del, C_8, PHPGPPKVRVSVGRRNKATRRKAASLLNS, (SEQIDNO:7287); XM_005623660.2, LTBP2, Ins, C_8, PHPGPQPAALRKQHRRHRGPA, (SEQIDNO:7288); XM_014119050.1, LOC106559698, Del, C_8, PHPHPP-PLPPN, (SEQIDNO:7289); NM_001033992.1, DAGI, Del, C_8, PHPLRPPWRARAPVPRT, (SEQIDNO:7290); XM_014116598.1, SIX5, Del, C_8, PHPNTGPPNPDS-PEPPPPHPPPLLPPGPSIPAPLLPCRTPT-PRGCSWGLRQGARRMRG WRPSRRF, (SEQIDNO:7292); XM_014121497.1, LOC476151, Del, C_8, PHPPHYLHRQRHLKQCKTVQ, (SEQIDNO:7293); XM_005628317.2, GPT, Del, C_8, PHPPPPPTPRGRRR-GRRCWRSWRQRRSSRSRCSTSPRASAATR-CRAPCTPSLACSCPP APCSALRN, (SEQIDNO:7294); XM_005622126.1, LOC102154422, Del, C_8, PHPRPLP-WETFLCSGCGFVHPASRQATCLL, (SEQIDNO:7295); XM_014107347.1, LOC102155751, Del, C_8, PHPRQAWGPARE, (SEQIDNO:7296); XM_534998.5, PPRCI, Del, C_8, PHQQCPWYLVLLAPMLCPPLAM-CLGYLLQPQSHLIAPAVPMGPWDGVQGCNTLHSGLLCHHLLCL, (SEQIDNO:7297); XM_005620138.2, SLC5A10, Del, C_8, PHRESRLRT-SPGGPWLRMCWWERKQVIARH-PRNMLFGPVCVASMPFCSCVSTSSST PTLP, (SEQIDNO:7298); XM_005616756.1, LOC102155403, Del, C_8, PHRGPLLPPHPGVPSCL-PRPHTHEGHGGQGRHTISSVPSPRSPLWSHSHHTQG, (SEQIDNO:7299); XM_005619036.2, SYNPO2L, Del, C_8, PHRGPPLCPATCQPPVPPALHAPRAP-SQPQVPCTSQPPIVLLRQEEPPSPPPPLALLP, (SEQIDNO:7300); XM_005636081.1, SFSWAP, Del, C_8, PHRGSTWPLTTAPCLLVWLCLALLG, (SEQIDNO:7301); XM_014116569.1, GLTSCR1, Del, C_8, PHRLLGPSRW, (SEQIDNO:7302); XM_014113517.1, DVL2, Del, C_8, PHRYPPCHRRGPAASGTLGLRP-STLTCPAAGRTWSLRRKPSQWCPCGGNGLVGETA GATGLVDPRGWSATWPGMRAPQPL, (SEQIDNO:7303); XM_014113515.1, DVL2, Del, C_8, PHRYPPCHRRGPAASGTLGLRP-STLTCPAAGRTWSLRRKPSQWCPCGGNGLVGETA VSTQGATGLVDPRGWSATWPGMRAPQPL, (SEQIDNO:7305); XM_014113516.1, DVL2, Del, C_8, PHRYPPCHRRGPAASGTLGLRP-STLTCPAAGRTWSLRRKPSQWCPCGGNGLVGETA VSTVGATGLVDPRGWSATWPGMRAPQPL, (SEQIDNO:7306); XM_546582.5, DVL2, Del, C_8, PHRYPPCHRRGPAASGTLGLRP-STLTCPAAGRTWSLRRKPSQWCPCGGNGLVGETA VSTVQGATGLVDPRGWSATWPGMRAPQPL, (SEQIDNO:7307); XM_844295.4, TNKS, Del, C_8, PHSAPAWPRGPPQPPQRRAAWPPSPPRGTA, (SEQIDNO:7308); XM_014115299.1, ARHGEFI1, Del, C_8, PHSASRGPDLCRILNSRNMPPRSFGIC, (SEQIDNO:7309); XM_537794.5, RABL6, Del, C_8, PHSPSPLWPPSD, (SEQIDNO:7310); XM_005620440.2, TP73, Del, C_8, PHTAQQPGPTWGPWAPEFSTT-TATPFQPAAR, (SEQIDNO:7311); XM_005642273.1, LOC102152155, Del, C_8, PHTPRGGGDRGGGVWRR-GLTLPTGPTAPTRGGRATPKGSLNLRAGTR, (SEQIDNO:7312); XM_014121497.1, LOC476151, Del, C_8, PHYLHRQRHLKQCKTVQ, (SEQIDNO:7313); NM_001003339.1, CYP2E1, Del, C_8, PITNSVSFPARA, (SEQIDNO:7314); XM_014120785.1, ATXN7L1, Del, C_8, PITVCLCTTQTMG, (SEQIDNO:7315); XM_854451.4, ATXN2L, Del, C_8, PKARCPRVGCIHSQLPHPHPIPTSDTPKFNLIPPSSSP-STPRGT, (SEQIDNO:7316); XM_005621365.2, ATXN2L, Del, C_8, PKARCPRVGCLHSQLPHPH-PIPTSDTPKVSSLARRLDFQEEPMTGFVSSR, (SEQIDNO:7317); XM_005621364.2, ATXN2L, Del, C_8, PKARCPRVGCLHSQLPHPHPIPTSDTPKYVG-WAEATVAAARGLLLALSFASLRPRSV VIQQPPSPLPPQLSVTPTVS, (SEQIDNO:7319); XM_860802.4, CACNA1G, Ins, C_8, PKERRAESLWFSL, (SEQIDNO:7320); XM_005626438.2, SRFBP1, Del, C_8, PKKCCYRRKINMKLIRV, (SEQIDNO:7321); XM_534035.5, PRKCDBP, Ins, C_8, PKKTRSR-GRGELRRGAGGVPGPAAAAHRVAEGTE-PAKGLVRPQRPGLADTHAGQA APPWARPER, (SEQIDNO:7322); XM_014111339.1, KDM5C, Del, C_8, PKPCPLLAAPAPRRTR-

MAWSLRWPLQAPQPLSLLCLLSCMCPAHSSHLSNSC, (SEQIDNO:7323); XM_005616816.1, LOC102151589, Ins, C_8, PKPQHFSMWKRHHHKGLCVQARAC-FPLTEHQGLAWPHDLTFSCKKQHRDLSASMH F, (SEQIDNO:7324); XM_005616815.1, LOC102151355, Ins, C_8, PKPQHFSVWKRHHHKGLCVQARACFPLTEH-QGLAWPHDLTFSCKKQHRDLSASMH F, (SEQIDNO: 7325); XM_014115739.1, TIAM2, Ins, C_8, PKPVPASGGVPG, (SEQIDNO:7326); XM_544671.4, SHC4, Del, C_8, PKPVSLGLGPHL-CRSSQARWGTGQPS, (SEQIDNO:7327); XM_005630690.2, LOC100683419, Del, C_8, PKR-PARPIQAFIFPPYPHWLAFPRHHCPQLHPASCLSAP-LALPSLAAVRHLWSPWQRL SRSCRC-CRNNWEKVSAPSILLPQLHCQATI, (SEQIDNO:7328); XM_014120602.1, LOC100683419, Del, C_8, PKR-PARPIQVSAPSILLPQLHCQATI, (SEQIDNO:7329); XM_545655.5, FAM134A, Del, C_8, PKTCWAPLRP-SQGKT, (SEQIDNO:7330); XM_014119273.1, LOC106559736, Del, C_8, PLAAASAARPGP, (SEQIDNO:7331); XM_844430.3, C2H1orf158, Del, C_8, PLACTLSRAS, (SEQIDNO:7332); XM_005625495.2, SMARCC2, Del, C_8, PLDPMAPHRSPTNKLLPQ, (SEQIDNO:7333); XM_005638159.2, ESRP1, Del, C_8, PLFQYYLSNLCPLRMLETVYAFAVFPMRPPLKTS, (SEQIDNO:7334); XM_014111420.1, GAB3, Del, C_8, PLFRHSCLSPPVVGWVWSSSGVGFWDGSLKER-ERTDAPRQVR, (SEQIDNO:7335); XM_014119807.1, ATG9B, Del, C_8, PLGAPNPPHPWPQ, (SEQIDNO: 7336); XM_014112436.1, CIB1, Ins, C_8, PLGFASSSEI-PAAAAAPPRASL, (SEQIDNO:7338); XM_003638937.3, HCRTR1, Del, C_8, PLGPGPSWLR, (SEQIDNO:7339); XM_540834.4, TMEM151A, Del, C_8, PLGRCPAGPRCPGWPRWTSPSWSGT-SAPTGSWYPATRRPWSWVPAPVPTSVAASAA VAP-SAAIRCPLPGPVGPACLSAAAACLWEL-GAGPHQGSSGA, (SEQIDNO:7340); XM_005619960.2, DVL2, Del, C_8, PLHPLSHQQCSPQGPLLSETWAL-CPQN, (SEQIDNO:7341); XM_014108280.1, LOC106557869, Del, C_8, PLHPPHAWPQGAWSSTG-PADLCPQVALGCQEAPGRSRDREATAP, (SEQIDNO: 7342); XM_005636179.2, SETD1B, Del, C_8, PLHSQR-PRLVSHPHPSCHRCHPSPQGCFP, (SEQIDNO:7343); XM_854467.4, CLIP1, Ins, C_8, PLHTPRQSERGAPVL, (SEQIDNO:7344); XM_005623432.2, KTN1, Del, C_8, PLKQLPQRRNQDRRSLKMEAMTRIKRWKLL-WHLQKSKNHYPSSKRLNKKVDQERR KFLQR-SKRQKNIYW, (SEQIDNO:7345); XM_005616718.2, LSR, Ins, C_8, PLLGDGLPGLAGAEA, (SEQIDNO: 7346); XM_014113225.1, PITPNM3, Del, C_8, PLLGPSPRWAGQKV, (SEQIDNO:7347); XM_005616067.2, ZSCAN18, Del, C_8, PLLHVDPVPMGGSVGSRGVWQVMVPCSLRRRD, (SEQIDNO:7348); XM_005642410.1, LOC102155373, Del, C_8, PLLSRSWMCPSHLLT, (SEQIDNO:7350); XM_014122116.1, SUGP2, Del, C_8, PLMASRARQPK-MAQQVHLPYHRPPQGPASLGRGSVASP, (SEQIDNO: 7351); XM_014121497.1, LOC476151, Del, C_8, PLPHPLPSQALQLRRCRLLLYLPLLLLLHPRCL-GRPHPQWFSTQD, (SEQIDNO:7353); XM_014113536.1, FXR2, Del, C_8, PLPPGPAQDTTLHLSAQC, (SEQIDNO: 7354); XM_005621674.2, SRRM2, Del, C_8, PLPPGTGPCTTGSGCRRPGAAAPTATS-SATCPWCGAAGVSGLTTRERRNCGAWRLP W, (SEQIDNO:7355); XM_014120934.1, LOC106559977, Ins, C_8, PLPPPRAAPV, (SEQIDNO:7356); XM_845621.5, MLLT6, Del, C_8, PLPQPLSPQRQTSLSRRWSSLALGP-SCASPPPPPARPGPGPRPLETISLPTFRGLGPQQA PTSGCPH, (SEQIDNO:7357); XM_005616928.2, COMMD3, Del, C_8, PLPSRIIRIP, (SEQIDNO:7358); XM_014114995.1, LOC106558989, Del, C_8, PLPVLLLGPLGQDSSSSHPPHHSPR, (SEQIDNO:7359); XM_849996.3, CDX1, Del, C_8, PLQPMK-SPPPQLGHPWGACAPALLASWGPPPQCRSRRSICH, (SEQIDNO:7360); NM_001003339.1, CYP2E1, Ins, C_8, PLQTLCRSPLGL, (SEQIDNO:7361); XM_014106885.1, ACSS2, Del, C_8, PLRGHAQMCRVS, (SEQIDNO:7362); XM_014112610.1, CLNK, Del, C_8, PLRGSAFLKSRKGPGK, (SEQIDNO:7363); XM_014121352.1, LOC611811, Del, C_8, PLRLC-CLQPPTSPSTTTACTLEPQVPSESLRRDQHHTPCPISR-PAEIRTACPSQLGWGS CPPLPCT, (SEQIDNO:7364); XM_543975.5, LZTS2, Del, C_8, PLRMRPCCTVSWKESSTTVRQSCSSCGTVWTRVR, (SEQIDNO:7365); XM_014122539.1, FRMD4A, Del, C_8, PLRSPWRGSGRCTIPATTMTSPP, (SEQIDNO:7366); XM_005629445.2, FREM3, Del, C_8, PLRSTGPPGAH, (SEQIDNO:7367); XM_546528.5, SIK2, Del, C_8, PLSAWPRP, (SEQIDNO:7369); XM_014110909.1, RAPH1, Del, C_8, PLSCFLINRKLVTEV-VIYRAMQRCGEDPLPLPPRETRIPSSQETG, (SEQIDNO:7370); XM_005626284.2, FLT4, Del, C_8, PLSVSSGTGGHGHPARPSPSAASAGGSRETTCHSARTGER, (SEQIDNO:7372); XM_844883.3, RANGRF, Del, C_8, PLTIGYLLVLKICHFCPGAWVTLNSW, (SEQIDNO:7373); XM_005616718.2, LSR, Del, C_8, PLTRRRTPRPRGSGGLRRTWP, (SEQIDNO:7374); XM_005633032.2, HDGFRP2, Del, C_8, PLT-STPSSSLVHTKQPSWDPRTCFLTTNVKISTGNP-TRGKASMRDCGRSRTIPTPATV LLCR, (SEQIDNO: 7375); NM_001103219.2, MLPH, Ins, C_8, PLVPSLSGHRQPAGPVCPGPHAWSSCRGRLPG-GRRPGGGGC, (SEQIDNO:7376); NM_001013846.1, CCKBR, Del, C_8, PMGVAGRRAGWLAR-TATAATCSFRARVRPWSCPR, (SEQIDNO:7377); XM_014114772.1, CELSR2, Del, C_8, PMPIFCTAYWR-GLAAAPLKSLRLTLALGSSEPVAPWIGKK, (SEQIDNO:7378); XM_005640282.2, LRP2, Ins, C_8, PMQVYVRRKLLF, (SEQIDNO:7379); XM_548376.6, NACC2, Del, C_8, PMSCPPLCPSRC, (SEQIDNO:7380); XM_014115113.1, KIAA1614, Del, C_8, PMWESQPGLHPGTEVYHQSGQQGTWTGT-PASPCRTQSRTGPLVPSRSLC, (SEQIDNO:7381); XM_014118314.1, BAG6, Ins, C_8, PNHQSPEGHPNFP-PERGTRGHDAHEYPRFRHTAWWSSECSHWP-PRTPWSWPDPGLH HPAALPAP, (SEQIDNO:7382); XM_014111339.1, KDM5C, Ins, C_8, PNPAHYWQPQHPGEPEWLGACAGHFRPLSPFLYSVS-SAACALPTAATSATVV, (SEQIDNO:7383); XM_014117646.1, LOC106559457, Del, C_8, PPAPAP-PELPAGHARP, (SEQIDNO:7385); XM_014116201.1, LOC106559219, Del, C_8, PPARLLQPSPWTRGDRPALV, (SEQIDNO:7386); XM_014115167.1, BRINP2, Del, C_8, PPASRPWTGCSPTAAPSTAPRSTLTSWSAT-GRVSPPGTGSTGSLPVGK, (SEQIDNO:7387); XM_014111408.1, KAZN, Ins, C_8, PPCGPASGQGE-PLPLPAALRHLRRICRRRRPVVHAKRHQLPSAP-DTLPLQRRQSRPST EEPAQPHCTVTRGS, (SEQIDNO: 7388); XM_014115306.1, NES, Del, C_8, PPCSSHRLGGSRFQRLYRLKPRWPSLPASCQDQRSL-GASNERPVQASPLRMLPLWPH PSALITLV, (SEQIDNO:7389); XM_005619566.2, FLI1, Ins, C_8, PPDL-HARHFLQLVWSGVTILDLPHGGDLPQPQRAPPP, (SEQIDNO:7390); XM_846419.3, ZNF362, Ins, C_8, PPGLHQDNPGPRPAWPPQVRARPQKDQGGEPR-GAACPRSPLPHPGLRRDCQGGQDI QV, (SEQIDNO:7391); XM_014112341.1, ADAMTS7, Ins, C_8, PPGPTPSARLVPRAGGQHEQRHRGRPRVGPVGACVC, (SEQIDNO:7392); XM_847877.4, NUTM2F, Del, C_8, PPGTRRGHSVGALRVPHPCSWRPL, (SEQIDNO:7393); XM_014119833.1, TRPV5, Del, C_8, PPLPCPGPHPTAAATGAGRSFVATPWDM, (SEQIDNO:7394); XM_014115018.1, PAQR6, Del, C_8, PPLPSFASLDYAGAEATPVGRRR, (SEQIDNO:7395); XM_014111293.1, ARHGEF10L, Ins, C_8, PPPFTGSFLQWCARAGSSQLPRSRNQLCTLFPTPR-SAMSHW, (SEQIDNO:7396); XM_014118871.1, LOC106559658, Del, C_8, PPPGLRAGGPELWAPPGP-PAGSAGAAGRGWGAP-TRSRCSPGIHFGSRGACSRRMSPA AR, (SEQIDNO:7397); XM_547146.4, NMRAL1, Del, C_8, PPPGPLGPQFPRRLAWQTRSWWWWCSGPQVL-REAPWPGRSWKMGRLEFEW, (SEQIDNO:7398); XM_005624049.2, TNRC6C, Ins, C_8, PPPGPRPA, (SEQIDNO:7399); XM_014121373.1, LOC106560025, Del, C_8, PPPGWAQHLHPPPAGPGAAVGRQGGGGRRCP-GAQVHRRRLPAGHRHRGCGAGRG GGPLGASRP-TRAAPPPSKA VGASFQGRGSRTSGVLVR-SAQPAAAGP, (SEQIDNO:7401); XM_005636179.2, SETD1B, Ins, C_8, PPPPPAAPAAARPFGREEEP-PLEKLQVDD, (SEQIDNO:7402); XM_539044.5, BACH2, Del, C_8, PPPPPPPPPRRIARGGRRAATRGAS-RRGGLRWNPGARR, (SEQIDNO:7403); XM_005628850.2, YBX1, Del, C_8, PPPPPSAPPTPSPA-PRAAAQGAAARAASHRRRLPAGTRRSSQRRFWEQ, (SEQIDNO:7404); XM_014118223.1, ZNF865, Del, C_8, PPPPTRPRNIQRPPSRSPRLPSLPALTSCLPTPPPQ-TARRRRRQRRPWYMVPCPSHCWG RTRCCSAGPGPVGPGGPAPTSLERHSAAASVG-GASGGVRL, (SEQIDNO:7406); XM_005626259.1, FIGLA, Del, C_8, PPPPWSRSPSWASRRPRCWRT-CCGSSSGRCPSWLPSAGSSGCRRAATRPPRTCSWCS RSGAGPTPRSASR, (SEQIDNO:7407); XM_014116364.1, LOC102155336, Ins, C_8, PPPRPGPARGTGSHDGGGLDGPCAGICDL, (SEQIDNO:7408); XM_005639946.1, ATP11B, Ins, C_8, PPPSSGCAQPPTAAARARPLGPRRPLSSRPGAGPGAG-GRARSYK, (SEQIDNO:7410); XM_014108311.1, LOC106557876, Ins, C_8, PPPTPRLFPRPTSP-PAAAGAPGHQAARDRRGEAVPGRGVLRGSSS-CQLCSRVT, (SEQIDNO:7411); XM_014108675.1, IFF01, Del, C_8, PPPWLSATTWAPTSTCSRP, (SEQIDNO:7412); XM_014121888.1, MAP4, Ins, C_8, PPPWRPQR-RHPGSWLPVPGCFL, (SEQIDNO:7413); XM_005619266.1, LARPI, Del, C_8, PPQPGNQRPNRSLPGTTRMRHRV, (SEQIDNO:7414); XM_014113971.1, RLTPR, Del, C_8, PPQPQTKEAAAPTP, (SEQIDNO:7415); XM_003434606.2, FOXD3, Del, C_8, PPRPLNTDLRRPP-PLRAHLGWRSKLAARPPARRE, (SEQIDNO:7416); NM_001284456.1, CX3CL1, Del, C_8, PPRPPP-PRPSLPTLPLPTP-PLPPPPPFHTQPQRTGLTPKADLCGSRETIPRQRIL, (SEQIDNO:7417); NM_001314087.1, KISSIR, Ins, C_8, PPRPRSCTAWALGAPQPPPRRGAERASPGRPGV, (SEQIDNO:7418); XM_005620971.2, MLXIP1, Del, C_8, PPSLPWLLPLPCCRKNLSSLPDSPSLP-SHLPQEECPHCLLPLPSHRPHSLAQALPLPPSP, (SEQIDNO:7419); XM_014111008.1, NRP2, Del, C_8, PPSSPPAPCSTSSSPPTTPGRGQASLCA-TRSSSRQALKTVQKTSQAPMGPSNPLGFLRST HTTWI-APLPSWPNPRWRSSCSS, (SEQIDNO:7420); XM_005634149.1, SCN5A, Del, C_8, PPTTASPGP-PAITRRCGRPTTAAARTSPTCPRPQTGTASLSC, (SEQIDNO:7421); XM_014109693.1, LOC106558086, Ins, C_8, PPVPSRRGCGGEARGGAELRAGRAAGAAPS-LAARTRAAASAGTSSGFRASRPDLSRF SATWQPARPPPRGKSMEQSVATSPWSV, (SEQIDNO:7422); XM_014110917.1, LOC106558305, Ins, C_8, PPVVPPAPPRGPRPWFRPTAL, (SEQIDNO:7423); XM_005616816.1, LOC102151589, Del, C_8, PQATALLHVETPPPQRSVCPSSCVFPSYRAPGPCLA-TRPHF, (SEQIDNO:7424); XM_005616815.1, LOC102151355, Del, C_8, PQATALLR-VETPPPQRSVCPSSCVFPSYRAPGPCLATRPHF, (SEQIDNO:7425); XM_014122046.1, SMARCA4, Del, C_8, PQDPQACPLGCQVSPPEGLPSLGLKDPWRMLLP-PRAHLRS, (SEQIDNO:7426); XM_005622734.2, HCN3, Del, C_8, PQEEVDGD, (SEQIDNO:7427); XM_005624035.2, LOC483345, Del, C_8, PQERPWPSH-WSSGCVCWWLGLKV, (SEQIDNO:7428); XM_005630746.2, CIART, Ins, C_8, PQFPRYHFL, (SEQIDNO:7429); XM_014108913.1, SH3PXD2A, Del, C_8, PQHLLASPRRPRRGQWAPRRARTPP, (SEQIDNO:7430); XM_849191.4, MCOLN1, Del, C_8, PQKRKT-SAVGSNTSS, (SEQIDNO:7431); XM_014118314.1, BAG6, Del, C_8, PQLPMRRQLPLVLGR-PRPWLPLLPLSSLQPRGL-PRQGQLPPQPPVTRGSSEFPTRAWN PWS, (SEQIDNO:7432); XM_540739.5, FNBP4, Del, C_8, PQNPLLPPLLPLL1, (SEQIDNO:7433); XM_844462.4, SPATC1L, Ins, C_8, PQPGRAAQAAHRRAAPQVPGR-LAAAAQLPVRARQGRPQAALRLV, (SEQIDNO:7434); XM_005616850.2, CACNG8, Del, C_8, PQPPARPR-PRCPGGGPRPPGCPWSSWSR, (SEQIDNO:7435); XM_014118314.1, BAG6, Del, C_8, PQPPVTRGSSEFP-TRAWNPWS, (SEQIDNO:7436); XM_005620593.2, LOC102153713, Del, C_8, PQPRGWWEGLRHTLRRQG-GRLMRDWARAAE, (SEQIDNO:7437); XM_014117950.1, AKNA, Del, C_8, PQPR-PACPGRPGTPSS, (SEQIDNO:7438); XM_014113873.1, PRDM16, Del, C_8, PQPSTTPAWASTSTSHPGHT-PAACPSRRLHLPSPHSPRASRASSLHPCTPGRLCYL-PRR CSRAP, (SEQIDNO:7439); XM_546149.4, ADAMTS14, Del, C_8, PQPTEAACVPGPCSNTR-CATARSVRGPTRTSGPSNVPSATPTTSTRMP-STAGSPMSLK MMPRSVS, (SEQIDNO:7440); XM_014117109.1, ESYT1, Del, C_8, PQPTPPSAPRCSR-TARALLRSIGVEAKGELGWQQRFRAVGGE, (SEQIDNO:7441); XM_014113377.1, PHLDB1, Del, C_8, PQQTTQQDSR, (SEQIDNO:7442); XM_014113536.1, FXR2, Del, C_8, PQQVP-GAAAPAAAAQMRTGPSWMGAWSLMGPV, (SEQIDNO:7443); XM_005627781.1, AIM1, Del, C_8, PQRPHQSHRIRYLTHSPQLSHLTGLLPPSLHPKARV-FELP, (SEQIDNO:7444); XM_014122403.1, PLK5, Del, C_8, PQRPPTSACCASLCPSGRCCCSSATGRCRSAA-GATGLTWC, (SEQIDNO:7445); XM_003435094.2, HOMEZ, Del, C_8, PQSHYLLVVVSRSQYLI, (SEQIDNO:7447); XM_862201.3, ZFP64, Del, C_8, PQSPRNKP, (SEQIDNO:7448); XM_014115739.1, TIAM2, Del, C_8, PQTSPSFWRSSWITSKRIQPMISAM-SLMSQVA, (SEQIDNO:7449); XM_848403.4, STX5, Del, C_8, PQWPWSLPLPTPCPAEIGPRSSCL-PASPCRAVRMESRQISQLCVLSGSVANLPSWPSA LGKTSATHLPSWRS, (SEQIDNO:7450); XM_545071.5, DCBLD2, Del, C_8, PQWWGHTTLCSPELTAAPP-PAPSMIPQKAGSQVRVPRTNWCTRCRRAHRRYQGRG GMVNVMSLKKFS, (SEQIDNO:7451); XM_846858.4, PDE2A, Ins, C_8, PRAAPGRESPRGCGLPEAAGLQWTGPLKSAREAL-GQAGGSTGS, (SEQIDNO:7452); XM_014111420.1, GAB3, Del, C_8, PRAPPRAPTARPARPGSRTPRPARR-PRAPRSRATCPSGARTRSPRARRRPEESPCPAW TT, (SEQIDNO:7453); XM_005622105.1, RAB40C, Del, C_8, PRARLRTARGATARSP, (SEQIDNO:7454); XM_014109869.1, COL18A1, Del, C_8, PRAR-TRRRRRRRTSPAWEPRS, (SEQIDNO:7455); XM_005629418.2, ARTN, Del, C_8, PRASAPLRPWCSP-SATCRVAPTSWCASASAAARAAGRAPRTT, (SEQIDNO:7456); XM_014109156.1, LOC491694, Del, C_8, PRAVRSPWG, (SEQIDNO:7457); XM_544073.5, PXDNL, Del, C_8, PRCRHPGWSPRSWRPRPR-SPPTTGTRTCSCSGASFWTTIWATRCLP, (SEQIDNO:7459); XM_005615988.2, LOC610549, Del, C_8, PRC-STFHRPLCKQSLWPHRCPAQVLRVRAHTHTASLSRPLL-WRQLGRV, (SEQIDNO:7460); XM_005616196.2, FAM71E2, Ins, C_8, PREDTCGG, (SEQIDNO:7461); XM_014121820.1, LOC106560103, Del, C_8, PRFLTNE-SPSTSSRRRASCVPEGRCQSPFLL-VCPPSPKPSRLLPSPAGSPRGQLEACGG RVP, (SEQIDNO:7462); XM_852361.4, TCF20, Del, C_8, PRGAALAISMGARGMWASFKHSTLPLVVCLIISRITR-GLSLQGVLSTNSRLPASSSSR YSS, (SEQIDNO:7463); XM_005636752.2, HOXC4, Ins, C_8, PRGLVCRQRRL-PRG, (SEQIDNO:7464); XM_005629711.2, NOMI, Del, C_8, PRGPGPPQPQPQPLPPLGNGLFWRPTRRRTGRS-ESWSGASA, (SEQIDNO:7465); XM_005630690.2, LOC100683419, Ins, C_8, PRGQPGPSRPSFSLHIHTG, (SEQIDNO:7468); XM_014108311.1, LOC106557876, Del, C_8, PRGRARAPTPAGSGAPTRAGNPPSPPA-PRFVSGGVALRRSRSHKSP, (SEQIDNO:7469); XM_014114367.1, FBXL19, Ins, C_8, PRGRAWAPQKKGEGGRE, (SEQIDNO:7470); XM_536612.5, PELP1, Del, C_8, PRGRGRGRW-GAPQPCRRLKSLLKKSPQLPQLCWKR-GLRVGGTKCQSPRRRLRQKT WRPRWRQRRQPCRRRSRMTRLPCWLTSSIVPLMTT-SHHRPQSLIP, (SEQIDNO:7471); XM_005616451.2, NKPD1, Ins, C_8, PRHKRSRPCPRDGPVRSGCRACP-WARQRSPPAPGLGAGGQAETPGL, (SEQIDNO:7472); XM_536512.5, PDZD2, Del, C_8, PRHRGPPSLQF, (SEQIDNO:7473); XM_540739.5, FNBP4, Ins, C_8, PRIPSSPPSSPSSCRRW, (SEQIDNO:7474); XM_005624035.2, LOC483345, Ins, C_8, PRKGHGPPTG-PLDVSAGGWDSRCER-WGHAAGQWGHRQRGPRGDLLQWPVGDRV, (SEQIDNO:7475); XM_014110676.1, CSRNP3, Del, C_8, PRKGSCPRCTGTATSPSTPRRSL, (SEQIDNO:7476); XM_846534.4, PRCC, Del, C_8, PRKLPQMPPSSMTKHLSGCRARGTEGGRRST-LWRLKGMTSSVGPSSG, (SEQIDNO:7477); XM_005616351.2, SULT2B1, Del, C_8, PRLDPSPSTR, (SEQIDNO:7478); XM_014117113.1, RASSF3, Del, C_8, PRLLESSLPAATAA, (SEQIDNO:7479); XM_537035.5, RBM15, Del, C_8, PRLRHRCPVSWRESETIRSMRE-CARRTAWSPGWELEQVLLLSEKWMRSHPRTISELT GRFSWAT, (SEQIDNO:7480); XM_003431951.3, HIVEP3, Del, C_8, PRPAPPPWTAAAPWAAWPRPPLAS-RPGGGTCPGSPGPVGAPPSPQEVGGPGHFHASP RTGAPQAL, (SEQIDNO:7482); XM_014110497.1, LOC106558231, Del, C_8, PRPAPTPLRKRR, (SEQIDNO:7483); XM_546111.5, CCDC6, Del, C_8, PRPARRPP-PRRSRRTPPPSL, (SEQIDNO:7484); XM_005615289.2, NFATC1, Del, C_8, PRPCCDHS, (SEQIDNO:7485); XM_014120434.1, NFATC1, Del, C_8, PRPCCDHSPAAP-PAHLRWARSSTDCRRLRGASLQPPGLCRRPRCVRT-VIIVWPPFP, (SEQIDNO:7486); XM_014118223.1, ZNF865, Del, C_8, PRPCPPVPPPRLLLLELPPWPP-PLRRGPVPLPGWACPLPRRGAARAHLPARSAGRSSR SPATSTSTRSSTPARSPSPVPCAARASTAGRASSGT, (SEQIDNO:7487); XM_849485.4, FAM209B, Del, C_8, PRPPALGPTGTLAPSAPLTSTSGLDT, (SEQIDNO:7488); XM_005638643.2, LOC102157171, Del, C_8, PRPPGWSHLTRASSWASPAPRAPWDLLARASGLSAL-CGEPSRSPGSVLLCPAPAPPR ALTVLQAVWPPPCSHALLLPRAL-TAFLCLLPSRAPGPCL, (SEQIDNO:7489); XM_005642274.1, LOC102152225, Del, C_8, PRPPRL-PASPDRTVAGAPRVPRP, (SEQIDNO:7491); XM_546201.4, RBP3, Del, C_8, PRPPSCHLRRRCPT-SLKPCSKPRCCPAGWATCASTPWRSWRRSRPSGR-SWCSWCGR G, (SEQIDNO:7492); XM_542216.5, PALM, Del, C_8, PRPRAPGKRTRWGPRPRPATPRT-STRRSSAVNAAPSC, (SEQIDNO:7495); XM_005629436.1, AMDHD1, Del, C_8, PRPRGPRSP-PRRGSSAQPALLPGMGL, (SEQIDNO:7496); XM_849736.4, FBXO28, Del, C_8, PRPRPR-PRSRAPRRPQPRRWLPTSCLKTTRWWRCPS, (SEQIDNO:7497); XM_014115699.1, IRF2BP1, Del, C_8, PRPRPWDPIPTGPPRPSQPLRTARPPWPPSCRWQTL-WARRTRRRTAAPCTPPLRPPGA TAAARCHRPPCPGSAAWHHGTGT, (SEQIDNO:7498); XM_544370.5, ZNF366, Del, C_8, PRPRRRPRAGPRPR-RAPTAWT, (SEQIDNO:7499); XM_014121843.1, APC2, Del, C_8, PRPRSAAPPPSWAVMWTGLVPPRRP-PLFPSSTKAWGWLRGAFPPAGTAPPAARPVC PPSTTCPAPWCQPPLTWLQRKPPPLPLPASWN, (SEQIDNO:7500); XM_003433123.4, ZBTB47, Del, C_8, PRPSSPPLPLRAAG, (SEQIDNO:7502); XM_005631293.2, CHRM4, Del, C_8, PRRAPWP-TRTLPTSPAPAAPRTTPRNDQPRSCPPRRPPRLPCP-PRPYSRGPSTPRPNGP RSRL, (SEQIDNO:7503); XM_014118099.1, NOL8, Del, C_8, PRRESKCRMRHLLHLQL, (SEQIDNO:7504); XM_005621365.2, ATXN2L, Ins, C_8, PRRGAPEW-GACTLSFHTLTLSLHRTPPR, (SEQIDNO:7505); XM_005621364.2, ATXN2L, Ins, C_8, PRRGAPEW-GACTLSFHTLTLSLHRTPPSM, (SEQIDNO:7506); XM_854451.4, ATXN2L, Ins, C_8, PRRGAPEW-GACTLSFHTLTLSLHRTPPSSISSLPAAPLPPPGEL, (SEQIDNO:7507); XM_849191.4, MCOLN1, Ins, C_8, PRR-GRPPPSAQILLHESL, (SEQIDNO:7508); XM_005629436.1, AMDHD1, Del, C_8, PRRGS-SAQPALLPGMG1, (SEQIDNO:7509); XM_005635333.1, NKX2-4, Del, C_8, PRRRRPPRAAWRCPCWSRTAS-RARTGPARPRPARPARSRPPRRPRRSSRSSRPARPRC TPRGPAWRPWTLRRGTSAAACWAPTCSTAGRG, (SEQIDNO:7510); XM_005622101.1, LOC102155632, Del, C_8, PRRRRRRRRRPCGHTARSALRPRPRDDATAR-GRLSR, (SEQIDNO:7511); XM_541178.5, FNDC1, Del, C_8, PRRRSAPLRPLLAAPREPHSPRPDTPTAAL-PRQAPPWAPRPGCGTPPAPLPSMPPPPLC CPCASA, (SEQIDNO:7512); XM_014117950.1, AKNA, Del, C_8, PRRRWSSWGL, (SEQIDNO:7513); XM_005622734.2, HCN3, Ins, C_8, PRRRWTA TRTSGPPSLSLPTLSAS-TGSWGWFSWVQGLGK, (SEQIDNO:7514); XM_005620294.2, IGSF9B, Del, C_8, PRRRYLLRE-HIHLHPGTLLHLRGWRL, (SEQIDNO:7515); XM_849688.3, LSMEM1, Del, C_8, PRRSSRTPATRD-TAAGACSLWG, (SEQIDNO:7517); XM_014114459.1, LOC106558910, Ins, C_8, PRRVPPPRLPAQAGSAGD- PLAHLAGGPGWAGGISS, (SEQIDNO:7518); XM_014114435.1, LOC106558903, Del, C_8, PRSCPWRCPLEVPPGALESTGTGWEQEPSQERGP-SQAWEGA, (SEQIDNO:7519); XM_540337.5, MOV10, Del, C_8, PRSGRKKMACPCK, (SEQIDNO:7520); XM_014115300.1, ARHGEFI1, Del, C_8, PRSMSWWH, (SEQIDNO:7521); XM_547544.4, GON4L, Del, C-8, PRSPSRPGTVLSWRSCMQ, (SEQIDNO:7522); XM_005629754.2, GBX1, Ins, C_8, PRSSEICAG, (SEQIDNO:7523); XM_005632636.2, SLC6A20, Ins, C_8, PRTGRHWTAG-GLLHHVHPPGGPGDFHHTLLQEEGRHAPRGL, (SEQIDNO:7524); XM_014111162.1, PADI2, Del, C_8, PRTLLGAPCPTCPSVPHPMTRSLCLPTARPQLR-PRPSA, (SEQIDNO:7525); XM_014122046.1, SMARCA4, Ins, C_8, PRTLRRAPWDARSAPR-RASQALA, (SEQIDNO:7526); XM_539055.5, PRDM13, Del, C_8, PRTPRRPSRPAGRGRASSLKCICHT-CLRRRRRPL, (SEQIDNO:7527); XM_014122376.1, POLR2E, Ins, C_8, PRTSAGGKDHPAQ, (SEQIDNO:7528); XM_014107801.1, CCDC92, Del, C_8, PRTSCLKRPAAA, (SEQIDNO:7529); NM_001002994.1, SCN5A, Del, C_8, PRTTASPGPPAITRRCGRPTTAAART-SPTCPRPQTGTASLSC, (SEQIDNO:7530); XM_843722.4, MAP3K12, Del, C_8, PRTYPEGSRAPPVSRTQTVTARNWTTPTVAK-PCSLRPPSLH, (SEQIDNO:7531); XM_014119322.1, MACF1, Del, C_8, PRVPDCLLLRVNPSAAGL, (SEQIDNO:7532); XM_014114207.1, GIGYF1, Ins, C_8, PRWHLPWQGQHSEPRPRPW, (SEQIDNO:7534); XM_531943.5, ADAMTS1L, Del, C_8, PRWPC-PLASTCPASAARCGPRPPRGRPWGALAGRTASPP-SCGRSRPPSSCRPPRWSRT SGRRWPWPAAR-SACSCTARP, (SEQIDNO:7535); XM_014115712.1, SLC25A29, Ins, C_8, PSAGRPDL-GRRVTRGHRAPSRAGPRAAAGAPPPGPGGPH-TRRGCGRRACGTPI, (SEQIDNO:7536); XM_014122539.1, FRMD4A, Ins, C_8, PSAVPGGA-PADALSPQRL, (SEQIDNO:7537); XM_014113199.1, ZBTB4, Ins, C_8, PSGGDRPVPCPRRPAPAQ, (SEQIDNO:7538); XM_545071.5, DCBLD2, Ins, C_8, PSGG-GIQHSALQN, (SEQIDNO:7539); XM_003638937.3, HCRTR1, Ins, C_8, PSGPGLPG, (SEQIDNO:7540); XM_848403.4, STX5, Ins, C_8, PSGPGPSPSQHHVL-PRSDPGVPVCLQVPAEPSEWNPDK, (SEQIDNO:7541); XM_005615674.1, LOC102154183, Ins, C_8, PSGPPAD-GAAGSSAGHPPARRAHLRRRGPARP, (SEQIDNO:7542); XM_005627781.1, AIM1, Ins, C_8, PSGRTKATGYVI, (SEQIDNO:7544); XM_014107094.1, HSPG2, Del, C_8, PSGSSPRPPRWSKGRPWI, (SEQIDNO:7545); XM_005622233.2, HSD11B1, Ins, C_8, PSGVLLGLLLLFCE, (SEQIDNO:7546); XM_005630772.2, SETDB1, Del, C_8, PSHLPHLY-PLCPHRQVTMTAWKVSLPNLGSR, (SEQIDNO:7547); XM_014120689.1, SETDB1, Del, C_8, PSHLPHLY-PLCPHRQVTMTWKVSLPNLGSR, (SEQIDNO:7548); XM_541589.4, CIC, Del, C_8, PSHPPHPPAPPQLPQAG, (SEQIDNO:7549); XM_014113536.1, FXR2, Ins, C_8, PSKCQAPPLPPPPHR, (SEQIDNO:7550); XM_005639783.1, CHRD, Del, C_8, PSLAWGALPYS-LSVTQRTL-CIFCCSSVDCWNPGVGDQPRFPCGSRFYTRGSYC-ESCR PMPQSRSQALLRSCPT, (SEQIDNO:7551); XM_014110466.1, CHRD, Del, C_8, PSLAWGALPYS-LSVTQRTLCIFCCSSVDCWNPGVGVSGMGQV, (SEQIDNO:7552); XM_855866.4, VTA1, Del, C_8, PSLRAY-SII, (SEQIDNO:7553); XM_546149.4, ADAMTS14, Ins, C_8, PSLRRPPVFRAHVPIPGVQQRGVSGALRGLPG-PAMCQAQLLLHPPECQAQLDPL, (SEQIDNO:7554); XM_005634658.1, LOC102156928, Del, C_8, PSLSGGQAWDRTMESWSLR-SPTHCLPTLDPRRLHPWGPFYLEFGDIPGVAGQH-PRAP KTTTTTTK, (SEQIDNO:7555); XM_844430.3, C2H1orf158, Ins, C_8, PSPAPCPAP1, (SEQIDNO:7556); XM_005620593.2, LOC102153713, Ins, C_8, PSPGAG-GRAFVTPSAARGVA, (SEQIDNO:7558); XM_005631925.2, MGAT4D, Del, C_8, PSPGLSRAGPR-SHVTVRPELGWRGRAPSVPHGGTEPWQGPAWP-PRGPRVAWARPA RPSWGRVGAARFPV, (SEQIDNO:7559); XM_846492.4, XIRP1, Ins, C_8, PSPGRSAAATAQGVLLQVPPAETSQRAPPPLQAHPP, (SEQIDNO:7560); XM_014122358.1, KCNN1, Del, C_8, PSPHLAQASRWWWPRASQPGLHLAVPGGSPR-TRKKKKMMKRMRQAGGGTQGRPQ MWATAWAIGGHSLRSGSASATMPSSSACSALL, (SEQIDNO:7561); XM_005639946.1, ATP11B, Del, C_8, PSPLLRLRPAPDRCRARQAPRPAPPPFVTSGGGAGRR-GAGPEL, (SEQIDNO:7562); XM_014119273.1, LOC106559736, Ins, C_8, PSPPPRPPARGRSIWPRSV, (SEQIDNO:7563); XM_005625313.2, DPM2, Ins, C_8, PSPPPSTLFPRESRRTAGPAM-PLETTFPGMQGGGGTLLSWDT, (SEQIDNO:7564); XM_542201.5, PCSK4, Del, C_8, PSPPQSATPGATVA-VPRLWY, (SEQIDNO:7565); XM_539694.5, NAV3, Del, C_8, PSPPVQAPVMVGRMTMPFLSLVTRKVLTVV, (SEQIDNO:7566); XM_005621674.2, SRRM2, Ins, C_8, PSPRARGHVQRDRAADAPGQRHQRLRPAQPVP-GAGPPG, (SEQIDNO:7567); XM_014114995.1, LOC106558989, Ins, C_8, PSPSSSSALWAR-TAALPTLLTILPGNNYPHL, (SEQIDNO:7568); XM_014121497.1, LOC476151, Ins, C_8, PSPTPSP-PRPCS, (SEQIDNO:7569); NM_001081710.2, SSPO, Del, C_8, PSPVPRTR (SEQIDNO:7570); XM_005623660.2, LTBP2, Del, C_8, PSPWTSASSAA, (SEQIDNO:7571); XM_014117109.1, ESYT1, Ins, C_8, PSQAARALPSLLL-DGHPAWGSEG-PLPLGDRADLRGSVCPDNPGRVHRIRPSLPRARG PPVPTPGQHGSRGAPPSQPPRALPAAPGRPGRCSAP, (SEQIDNO:7572); XM_005626284.2, FLT4, Ins, C_8, PSQCPVALAAMDTLQDLHQAQPQPAAAER-PHATVPGLARGDHPGCREPHREPGHL DRVCGGEE, (SEQIDNO:7573); XM_014117109.1, ESYT1, Ins, C_8, PSQPPRALPAAPGRPGRCSAP, (SEQIDNO:7574); XM_014113123.1, FYB, Del, C_8, PSRSPCLPCLPWAH-RHPNPADLPTLT, (SEQIDNO:7575); XM_541488.5, PNKP, Del, C_8, PSSCPRTGKPLSWAGDP, (SEQIDNO:7576); XM_540739.5, FNBP4, Ins, C_8, PSSPSSCRRW, (SEQIDNO:7577); XM_014114276.1, LOC100687089, Del, C_8, PSSPYSGLTTSLALPFFCL, (SEQIDNO:7578); XM_847581.4, KIAA1024, Del, C_8, PSTDCPSSPKTAS-WWSRCSARTPTRHPSKPT, (SEQIDNO:7579); XM_005619960.2, DVL2, Ins, C_8, PSTPCPTS-SAAPRGPSCQRPGLCAPRTDS, (SEQIDNO:7580); XM_014108280.1, LOC106557869, Ins, C_8, PSTRLTLGHRELGAAPGPQICVHRWPSAARRPL-GAAGTEKPRPL, (SEQIDNO:7581); XM_844550.3, ZDHHC23, Del, C_8, PSTTPPRTLS, (SEQIDNO:7582); XM_005630746.2, CIART, Del, C_8, PSVPQVPF-PLAMVL, (SEQIDNO:7583); XM_005617044.1, ZNF438, Del, C_8, PSWGPIQA, (SEQIDNO:7584); XM_005632562.2, USP19, Del, C_8, PSWLRQP-PRQKLRNSSGYHH, (SEQIDNO:7585); XM_846419.3, ZNF362, Del, C_8, PSWTPSRQSRATACLAPPSP-SAAAKRSRRRTQGGRLSS, (SEQIDNO:7586);

XM_014115299.1, ARHGEF11, Ins, C_8, PTAHHGAQTSAGS, (SEQIDNO:7587); XM_005641102.1, ARHGAP6, Del, C_8, PTATATPTLCGSPRVTSPGTACRAAACA, (SEQIDNO:7588); XM_014113517.1, DVL2, Ins, C_8, PTATPPATGEDQRHRGL, (SEQIDNO:7589); XM_546606.6, PERI, Ins, C_8, PTCHYSLPGCRPALPSPGVLPSGRLPVSCLCPYSWAPCSLPCPARDPNGGLGAS, (SEQIDNO:7590); XM_860394.4, DLGAP4, Ins, C_8, PTCTPSRLPQPWGGHRHQLCQAGLLVYSDPQPRP, (SEQIDNO:7591); XM_005639159.2, AFF1, Ins, C_8, PTCVILILILPEASQACTKEAKAGS, (SEQIDNO:7592); XM_005619036.2, SYNPO2L, Ins, C_8, PTGAHPSAQPRASLRFPQHSTLLGPRHSHKFPVHPSPQSSCYARRSPRAPRPL, (SEQIDNO:7593); XM_005636081.1, SFSWAP, Ins, C_8, PTGGRRGHLLQHPACWCGCA, (SEQIDNO:7594); XM_014106590.1, TRAK1, Del, C_8, PTHLCRHPRPPRPPLSSSARALPMTTSWPPSRPAPS, (SEQIDNO:7596); XM_005632636.2, SLC6A20, Del, C_8, PTHWPSLDCWWPPPPCASPWWPWGLSSHAASRGRETRPPWP, (SEQIDNO:7597); XM_005619042.2, ZSWIM8, Del, C_8, PTLMMSNGCWGWQQSWE, (SEQIDNO:7598); XM_014111408.1, KAZN, Del, C_8, PTLRTGKRSG, (SEQIDNO:7599); NM_001033992.1, DAG1, Ins, C_8, PTLYGPHGGQGLPSQEHDPVPVAPSLRAPL, (SEQIDNO:7600); XM_534998.5, PPRC1, Ins, C_8, PTNSAPGIWYSWHLCCAPHLQCALGTSSSPSPTL, (SEQIDNO:7601); XM_005622126.1, LOC102154422, Ins, C_8, PTPARSPGRRFSAAAAGSCTRLPARPHACSKTCTPEPPRGARSPRRPICSRLSWPGAFP GHLSVATGNKM, (SEQIDNO:7602); XM_014113545.1, KDM6B, Ins, C_8, PTPAWPSH, (SEQIDNO:7603); XM_014108306.1, LOC610488, Ins, C_8, PTPGGSDGRNRAGGDRAAVLPLF, (SEQIDNO:7604); XM_547064.5, INO80E, Del, C_8, PTPHSLLTTWPCSCPSPAP, (SEQIDNO:7606); XM_005628329.2, LOC102154101, Ins, C_8, PTPKSSWGCPK, (SEQIDNO:7608); XM_014116569.1, GLTSCR1, Ins, C_8, PTPPAPPIPAPRGAAAPSSPPSSRLHLLWRGLHGYVHQAASPYAS, (SEQIDNO:7609); XM_014116364.1, LOC102155336, Del, C_8, PTPPRSCTGYGVP, (SEQIDNO:7610); XM_014121497.1, LOC476151, Ins, C_8, PTPPTTSIVRDT, (SEQIDNO:7611); XM_537794.5, RABL6, Ins, C_8, PTPQAPCGLLQTEE, (SEQIDNO:7612); XM_005616451.2, NKPD1, Del, C_8, PTPQTEPAMPPGRSGQVRVPSMSVGTPAKPTSPGTGRRGASRDPWP, (SEQIDNO:7613); XM_014120825.1, GLI3, Ins, C_8, PTPRFGQPFTVQVAWPADSGSPWGAEGPQQHYLKAGRMPPSESCQGREAHADISAK PWW, (SEQIDNO: 7614); XM_540363.4, GLI3, Ins, C_8, PTPRFGQPFTVQVAWPADSGSPWGAEGPQQHYLKAGRMPPSESCQGREAHDISAKP WW, (SEQIDNO: 7615); XM_005623834.1, LOC480441, Del, C_8, PTPRIRGRPKGSSA, (SEQIDNO:7616); XM_546245.4, FOXI1, Del, C_8, PTPTCGSTGLP, (SEQIDNO:7618); XM_014119050.1, LOC106559698, Ins, C_8, PTPTPRRCPQM, (SEQIDNO:7620); XM_014116598.1, SIX5, Ins, C_8, PTPTRAPRTQTARSPPPPPTPPPCCPPAPPSPPPSSPAGPRPRGAAPGVCGRGRGG, (SEQIDNO:7621); XM_014107347.1, LOC102155751, Ins, C_8, PTPVRLGVPPGSDTLPHGSSSKSERGPIPP, (SEQIDNO:7622); XM_005615728.2, VASP, Ins, C_8, PTPWCVPLRGLCGRARSRGRPTPCAPSPHSTRHQWWGNRGPRSCSSHCRSQTQESQ QARGGLRGAPSP, (SEQIDNO:7623); XM_014110154.1, THEMIS2, Ins, C_8, PTQAPQKSGSQWAEETKQQGEKRPVF, (SEQIDNO:7624); XM_547735.5, ZFHX2, Del, C_8, PTQCPTKQPALLPKPF, (SEQIDNO:7625); XM_014114459.1, LOC106558910, Del, C_8, PTQGPPSAASCTSWVRRGPPGSPGGRPGLGGGHLVLMMGGTWAR, (SEQIDNO:7626); XM_844295.4, TNKS, Ins, C_8, PTQPRPGPGDHPSLPNGGRPGPLRLPAARPSAAGGGWQSGSARQASIPGAG, (SEQIDNO:7627); XM_005619566.2, FLI1, Del, C_8, PTRPPCPSLPPACLERRHNTGPPPRGGSTPTPTCPATLTPTCPHT, (SEQIDNO:7628); XM_014121261.1, BRSK2, Ins, C_8, PTSARTELGCWA, (SEQIDNO:7629); XM_846858.4, PDE2A, Del, C_8, PTSCPRKGKSERLWSPGSGWAAMDWAPQICQGSPWPGWWLHWLLTAKCWSCRW WTRRLGLWRPSSWCTVAS, (SEQIDNO:7630); XM_540889.5, RCOR2, Ins, C_8, PTSHPPCSGCLPPQCPPRPTASTHPDWSPSGASSTLTV, (SEQIDNO:7631); XM_014121888.1, MAP4, Del, C_8, PTSLAAPAQAPGLLAPCPGLLS, (SEQIDNO:7632); XM_005616609.2, HNRNP1, Ins, C_8, PTSLRREKDGPTSGGSPSGPKSLRPPVWAPPTPSPTTRVWPPRRQPCAHGLWLGSI, (SEQIDNO:7633); XM_005616893.2, LRFN3, Ins, C_8, PTSPASQQHQL, (SEQIDNO:7634); XM_538777.4, ZNF462, Ins, C_8, PTTPATRPQY, (SEQIDNO:7637); XM_005621273.2, FBRS, Ins, C_8, PTTPPPLLVLPWPHPAPTPTPAAGARAPWGLRC, (SEQIDNO:7638); XM_014121497.1, LOC476151, Ins, C_8, PITSIVRDT, (SEQIDNO:7639); XM_005636179.2, SETD1B, Del, C_8, PITITSSPRRSPALRARGGTTIGEVTS, (SEQIDNO:7640); XM_014117924.1, LOC481671, Ins, C_8, PITTITKPH, (SEQIDNO:7641); XM_014117969.1, SEMA4D, Ins, C_8, PVAPARENVRPHRWAACRPGHGIWDDGGIRTGPQDHLGAQRGAAGEVSRARHLQL LGVAAK, (SEQIDNO:7642); XM_014116554.1, LMTK3, Ins, C_8, PVLLPLLRLACAGDPGASRPGPRRPARRPRGEL, (SEQIDNO:7643); XM_539694.5, NAV3, Ins, C_8, PVLQFRPQ, (SEQIDNO:7644); XM_005632319.2, DAG1, Ins, C_8, PVLQYAPHPTGGESPSPPS, (SEQIDNO:7645); XM_005629424.1, ZNF219, Del, C_8, PVLRRRGRRAPGCRGPRSG, (SEQIDNO:7646); XM_005642274.1, LOC102152225, Ins, C_8, PVPPACPRPPTARSRARRACRAPNSALRGPKPASPLLGVLPPPWPPWLGGGVPGRSA LGPPRKGRREARGGCWGGASLRVCGRAFSGEPVA, (SEQIDNO:7648); XM_005638708.1, LOC102154051, Ins, C_8, PVPPGESIGVGRRPLRSAARPSEATAAGSSSMGMFSSAPKNTPYP, (SEQIDNO:7649); XM_540881.6, NRXN2, Del, C_8, PWGPGPPRPLSRGGPRPCAPA, (SEQIDNO:7651); XM_005642274.1, LOC102152225, Ins, C_8, PWPPWLGGGVPGRSALGPPRKGRREARGGCWGGASLRVCGRAFSGEPVA, (SEQIDNO:7652); XM_014119467.1, SZT2, Ins, C_8, PWRPSAPEGPQCYPGRLRVNLASGSGASPNLGPSAPQIHL, (SEQIDNO: 7653); XM_014117848.1, NPR2, Del, C_8, PWTIPPVPLTWTTHPVIKPHFPLWRLWPWAQESPSSCLVFPASSFSES, (SEQIDNO:7654); XM_014117851.1, NPR2, Del, C_8, PWTIPPVPLTWTTHPVIKPHFPLWRLWPWAQESPSSCLVFPASSFSVLTES, (SEQIDNO:7655); XM_014117150.1, SMARCC2, Ins, C_8, PWTPWPLTVPQPTNSSRNDARGSARQRAPRRGG, (SEQIDNO:7656); XM_014117151.1, SMARCC2, Ins, C_8, PWTPWPLTVPQPTNSSRNDARGSARQRAPRRGGPEPCHCGSCSGQPPAQCQPTARPR YPSASRPH GPEPRHSHPCATSTV, (SEQIDNO:7657); XM_005625495.2, SMARCC2, Ins, C_8, PWTPWPLTVPQPTNSSRNDARGSAR

QRAPRRGGPRYPSASRPHGPEPRHSHPCATST V, (SEQ ID NO:7658); XM_014113123.1, FYB, Ins, C_8, QAEAPASPVYLGPTATQTQQTSQR, (SEQ ID NO:7659); XM_014114200.1, SRRT, Ins, C_8, QAGQHRRD, (SEQ ID NO:7661); XM_005634658.1, LOC102156928, Ins, C_8, QASPGVKPGTERWRVGAYAALLTVSQR, (SEQ ID NO:7662); XM_014115113.1, KIAA1614, Ins, C_8, QCGNPSLDSILGQRCTTRAASRGRGLGLRHLPAGLRAEQDLWSQAGVCAEPQA, (SEQ ID NO:7663); XM_014114772.1, CELSR2, Ins, C_8, QCQYSVPPIGGAWRQPL, (SEQ ID NO:7664); XM_005619930.2, MINK1, Ins, C_8, QGASEDLLHCCRAQHQWGRRGPAHSGCPRQTSQQLRLANLSAKAGRAGHPQVSRA PRSAPWPAQRL, (SEQ ID NO:7665); XM_014117950.1, AKNA, Ins, C_8, QGDGGAVGVCKASRLPCIR-GQRWLPPGPGQSRGNSSRPYPAAPPPGHQDC-SIPPEQS DQLGGKWHL, (SEQ ID NO:7666); XM_014112550.1, ADD1, Ins, C_8, QHPCQAWGRPATGAHFRRGQ, (SEQ ID NO:7667); XM_014112554.1, ADDI, Ins, C_8, QHPCQAWGRRWMC, (SEQ ID NO:7668); NM_001003247.L KCNB2, Ins, C_8, QHSPAAARHHGGLLPHRPAAHQHHPPRRDPLPGRQALLGAEGSAHCQGPSKGLSPR FPKQKLFPFSSRERRSFTEI, (SEQ ID NO:7669); XM_005628809.2, PTPRZ1, Ins, C_8, QIPSVLHADGD, (SEQ ID NO:7670); XM_005626438.2, SRFBP1, Ins, C_8, QKSVVTGGR, (SEQ ID NO:7671); XM_547735.5, ZFHX2, Ins, C_8, QLNAQRSSPHCCQSPSRKLWL, (SEQ ID NO:7672); XM_005631207.2, SSRP1, Ins, C_8, QLRRLGIRI, (SEQ ID NO:7673); XM_014109393.1, LOC100686862, Ins, C_8, QLRVRRGWAA, (SEQ ID NO:7674); XM_014106590.1, TRAK1, Ins, C_8, QLTYADTHVLPALL, (SEQ ID NO:7675); XM_847992.3, NCOR2, Ins, C_8, QQGLRAAAPGTPRLQSLGHRPHPSKEPRTP-PRRPGPACAARLDHGPASGKDSK, (SEQ ID NO:7678); XM_005641102.1, ARHGAP6, Ins, C_8, QQPQP-PLRCVEVRG, (SEQ ID NO:7679); XM_005623834.1, LOC480441, Ins, C_8, QRPGYVAVRKVHRL, (SEQ ID NO:7680); XM_005629424.1, ZNF219, Ins, C_8, QSSAGGGGGLRAAGGPGAV, (SEQ ID NO:7681); NM_001013846.1, CCKBR, Ins, C_8, QWELPAG-GRAGWRGRRRLLRAASALASDP-GAVRADRAHSWARRWPPALPGQAVG QEARGADAAGDRRAFFPVLVATV, (SEQ ID NO:7682); XM_003432577.3, ERF, Ins, C_8, RAPQARARRGSRGGAVHASQAALQAALE, (SEQ ID NO:7683); XM_005629711.2, NOM1, Ins, C_8, RGDQAPRSRSRSHCRRSETGSSGGQRGGGPGDPKAGAVPR-LEQAQKEGRRQLRAAE LCPRWARLHPRSPGVWKK, (SEQ ID NO:7685); XM_014106952.1, RTEL1, Ins, C_8, RGGAGTRPPHLVRPT, (SEQ ID NO:7686); XM_003431951.3, HIVEP3, Ins, C_8, RGLRPRPGPQQLRGLPGRGLRSLPGPEEAPVRGAQDQSGLPRALRKWGARGTSTPAP GQGPPKRL, (SEQ ID NO:7687); XM_005629436.1, AMDHD1, Ins, C_8, RGRADPGAPPAGVRPRSPPFSPGWVYKSHRSC, (SEQ ID NO:7689); XM_546111.5, CCDC6, Ins, C_8, RGRRAARPLAAAGAPPLPAL, (SEQ ID NO:7690); XM_544403.5, IRX3, Ins, C_8, RGSRRAPSPAALARRR-GRRGSQTRLGAAEQVPRLDQPAVPRPAAGPTPAPALPARLG PSTPAGTSRSRGPPGRGRCCLRSACGARGRSRSL, (SEQ ID NO:7691); XM_547146.4, NMRAL1, Ins, C_8, RLPGLWGRSSRGGSHGR-REAGGGGVRGHRCSGRLRGPDAPGRWDV, (SEQ ID NO:7693); XM_014113186.1, NCAM1, Ins, C_8, RPAGGPRHRRPGPRARPARRRREEPGRGSRGPH, (SEQ ID NO:7694); XM_014119242.1, LOC106559725, Ins, C_8, RPAGPRAARDRAAGRPEG-GRRGPPGRAAGNSGE, (SEQ ID NO:7695); XM_014121373.1, LOC106560025, Ins, C_8, RPRAGPSTCTRPLRDPAQQ, (SEQ ID NO:7696); XM_014108675.1, IFFO1, Ins, C_8, RRHGSPQRPGLQHQRAQDPEPPLPLLPGQGA-RAGAPQPAAREAAAAGAGGG, (SEQ ID NO:7698); XM_014115167.1, BRINP2, Ins, C_8, RRPAAPGLAAHR-PRPLPPRPGVR, (SEQ ID NO:7699); XM_545655.5, FAM134A, Ins, C_8, RRPAGPPSGPLKARPRLGRG-GRCGSQGNLASALVPPSFCEHALQWG-GLSHRWSAAV PGRTSGDTEPRGSEW, (SEQ ID NO:7700); XM_005628850.2, YBX1, Ins, C_8, RRPRPQRRRHQARHHGQRRRERRPGR-PHIGGACRRGQEGHRNEGFGNSKMVQCKK RIWFHQQE, (SEQ ID NO:7701); XM_003639988.3, MMP21, Ins, C_8, RRRRPGPGRAQVPEGQRAA-GQRAPGRGHPGGHEQAALRGPRHPGPAAPRRPAAPQ ALPAAAAAARGPAA, (SEQ ID NO:7703); XM_548709.6, DPYSL4, Ins, C_8, RRTLQHHVSVL, (SEQ ID NO:7704); XM_005632287.2, LOC102152377, Ins, C_8, RTQRTGR-SWGEAEPRAAGARRGADRGRVLAPRHTHP-FLSRGVAPAPQG, (SEQ ID NO:7706); XM_014107494.1, RHOBTB2, Ins, C_9, HHCGAR-SPVQQRGVPRPPPGGPAVCGCHTGAAGAGAHL-CPQDLPLHLVLQVLRPVP HGPK, (SEQ ID NO:7708); XM_014111415.1, LOC612200, Ins, C_9, HHGQPELQGSPGLRDPRGGSRYFAC, (SEQ ID NO:7709); XM_005634658.1, LOC102156928, Ins, C_9, HPGSAGGPQSRTPRRAQGPAVSPAAPNARRTGR-PETPPPPQCPTPRCAHRPQSSRPRS APPPR-SARRPQGPTPRI, (SEQ ID NO:7710); XM_014121183.1, MADD, Ins, C_9, HSASQHWQVERGQAS-DRNWRGVSAPANL, (SEQ ID NO:7711); XM_014116237.1, BAHCC1, Del, C_9, PAAPRRHHVPA-PRALYPSAPLAAPGPAPGCPAPRTRAGRAGG-PEPTSVRWNQTCLL DTPALP, (SEQ ID NO:7713); XM_014116598.1, SIX5, Ins, C_9, PALPPWTSDPTLLGHISAPPTPTRAPRTQTAR-SPPPPPTPPPCCPPAPPSPPPSSPAGPRP RGAAPGVCGRGRGG, (SEQ ID NO:7714); XM_014121819.1, CAMSAP3, Del, C_9, PAPLRCWPFWRGGAPCPRCPSALCRRRT, (SEQ ID NO:7715); XM_014114459.1, LOC106558910, Ins, C_9, PAPRPASGTPRGRPPRAPARPSHGGPAP-DAAPAAGDLPGSCPTPPSAPRGPPPRRVPPP RLPAQAGSAGDPLAHLAGGPGWAGGISS, (SEQ ID NO:7716); XM_014120235.1, TMEM214, Ins, C_9, PAPRPL-SACHYPSSNPDDKHPL, (SEQ ID NO:7717); XM_540485.6, ARL16, Ins, C_9, PDAAHGGHRPDRHRGPEEDHHPGAG-GLHGPHLAQLLWRLPLSPVHDGCRQPHSAV RIL-CATPGSSFCRRTRRSISPDTLQ, (SEQ ID NO:7718); XM_014120232.1, LOC106559875, Ins, C_9, PEASR-GAQPPSRRPPLAQQADL, (SEQ ID NO:7719); XM_005624164.1, SLC16A5, Del, C_9, PFPGPPPPP, (SEQ ID NO:7720); XM_014110159.1, LOC106558165, Del, C_9, PFRGARGRV, (SEQ ID NO:7721); XM_014114181.1, RASA4B, Ins, C_9, PGALSALHITPSHWGAGL-RALLGWVDWGPEARPCPPV, (SEQ ID NO:7723); XM_005640418.2, AAMP, Ins, C_9, PGDPELPW, (SEQ ID NO:7724); XM_014116573.1, DACT3, Ins, C_9, PGFPPWGRPGPKNC, (SEQ ID NO:7725); XM_005634649.1, CHST2, Ins, C_9, PGGAAPRTHPPGP-PYSVPPSCRRRGGPRRCSRRRRRGRGGRGGRG-GRGPSPQWHS GPRGWRRQEAVGVRVHHVAL-

GLIVLR, (SEQIDNO:7726); XM_014114582.1, LYRM1, Del, C_9, PGGLVRPGLPDLPDQRRPRLSKAPGAASS, (SEQIDNO:7727); XM_014117590.1, LOC102151723, Del, C_9, PGSAGLGGHLAAVASRRTPRTPAC, (SEQIDNO:7728); XM_005638643.2, LOC102157171, Del, C_9, PGSPAVPPRCQASTRALAPSPAPEWRQGGRV, (SEQIDNO:7729); XM_014118308.1, PRRC2A, Del, C_9, PHLAERAALRPAGALAQAAVVVGSLQRNQGPLPAGLGL, (SEQIDNO:7730); XM_536612.5, PELP1, Del, C_9, PHLLPLCRALWPCRRHSWYPRRLLVEEDPLPWRKT, (SEQIDNO:7731); XM_014118223.1, ZNF865, Del, C_9, PHRPSLMLPSPPRNGASSTSLDTSTFLGI, (SEQIDNO:7732); XM_005632764.2, WIZ, Del, C_9, PHRRPRRPS, (SEQIDNO:7733); XM_014111168.1, SPEN, Ins, C_9, PITSCTRRTL, (SEQIDNO:7734); XM_014115022.1, SKOR2, Del, C_9, PKSRAPSATTRPRRRRRPR (SEQIDNO:7735); XM_014107007.1, DIDO1, Del, C_9, PLATSWAQGGRIPVSLKDPEAKHQISCQDPGGCSLSSSRSRG, (SEQIDNO:7736); XM_854614.4, MBD6, Del, C_9, PLGDPALP, (SEQIDNO:7737); XM_014112383.C ADAMTS17, Del, C_9, PLGQEALTAWEPVWSMLSARTCPALRACPASETSSARHMTA, (SEQIDNO:7738); XM_541489.6, MED25, Del, C_9, PLLDPSFGLRTLGPTPNCGVSSSTHLRLRLGCPHPKLPSTTSSHQGLQHCCHHTRAW GNPSWGPPSCTHHLPSPGPHSFPRELRCQVRCC, (SEQIDNO:7739); XM_005642172.2, RAB40B, Ins, C_9, PLSSSRTQKAGPGHHCPGLGGGGAVHTEDVPGAAAHPRPRVPVQHVCSAPGQP, (SEQIDNO:7740); XM_014111569.1, NLGN3, Del, C_9, PMTHCASLHCLTTR (SEQIDNO:7741); XM_541409.5, ZNF628, Del, C_9, PNLAKPLPQWASPQLPPPRWYKWYPLALHLEV, (SEQIDNO:7742); XM_014119102.1, LOC102153462, Del, C_9, PPARARCGRTRGGLGGCCARCARGAPRETLGASSPGGCGPATRQGHSSALS, (SEQIDNO:7743); XM_005628643.2, LOC102153462, Del, C_9, PPARARCGRTRGGLGGCCARCARGAPRETLGASSPGGCGPATRQVGHGRLALRSPE DPAPPG, (SEQIDNO:7744); XM_014114176.1, LOC489812, Del, C_9, PPPGPALAQP, (SEQIDNO:7745); XM_014109694.1, DONSON, Del, C_9, PPPPPPPILMVKPDAKLT, (SEQIDNO:7746); XM_005635892.1, DMTN, Del, C_9, PPPPSARPPARWRAPPGPGTHAHSHRPPFTLPSNHLPPLGASAPPAAPVFPALPPASW PRWTTRCWATRTWLPSPRTRPSWTSSGLTS, (SEQIDNO:7747); XM_014120095.1, LOC102155747, Del, C_9, PPQAPTPTPPSRSSARRIPETANPARLTAQRRSGGAPHPAFCTPKSGRRRAPPRESGSG VGGGARSRRPRPLWDPN, (SEQIDNO:7748); XM_538915.5, FRS3, Ins, C_9, PPQQQQRGPF, (SEQIDNO:7749); XM_005637416.1, KCNH3, Del, C_9, PPRAQPAGALLRPSGGGQSAHPRPRAAEKDASPRR (SEQIDNO:7750); XM_005634658.1, LOC102156928, Del, C_9, PPRQRRRSAEPDAPQSSRSCSVPRSAQRPQNRTPGNAPPPAVPDAPLRPPPAELEAPQ CPPPPQRPTPAGPDAPH, (SEQIDNO:7751); XM_014121188.1, MADD, Del, C_9, PQCLPALASRTWTGVRQKLERA, (SEQIDNO:7752); XM_855872.4, MADD, Del, C_9, PQCLPALASRTWTGVRQKLERGLKRCCGPTA, (SEQIDNO:7753); XM_014121190.1, MADD, Del, C_9, PQCLPALASRTWTGVRQKLERGQCAGEPMTIHTSSPNMAFPLRRRMMSRGKVTLPD SANMSMAIGLKRCCGPTA, (SEQIDNO:7755); XM_547535.6, SMG5, Del, C_9, PQGRAASPRRRSSIPSGFTGLWWRLCIDSTSSFATKLLIKKCLNQRTLA, (SEQIDNO:7756); XM_014121934.1, PRAM1, Del, C_9, PQPSPHCPLAPGMSRASEEPQPQPQL, (SEQIDNO:7757); XM_005640437.2, LOC102152812, Del, C_9, PQRDLRSSPRGPW AWSECPWHPGLSSLLRPLSYHPGWRSRPPQAQPPNLSRPDPLPARPSSNFSPSDGTPS PSSQCNKMVQAGGPRTWWA, (SEQIDNO:7758); XM_539202.5, FAM83H, Del, C_9, PQRGRARHLTLSPRGAPPLPTRSGKGAPPRPSRSAGPARCPPCPSAGPAQCPPCPSAG PASPLPSPRSPPRPAPRRSRRAAPWRCCARAPCASASC, (SEQIDNO:7759); XM_014116598.1, SIX5, Del, C_9, PRAAPLDK, (SEQIDNO:7760); XM_014122404.1, PSPN, Del, C_9, PRAPRTPSSFPPRCHLPSAAPCPLQVAAHAEPWPARASCGACPCLWPSWVWATRRR RRSPSATVRAAAPAACAPSTA, (SEQIDNO:7761); XM_014118922.1, TEAD2, Ins, C_9, PRECGRPAD1, (SEQIDNO:7762); XM_539202.5, FAM83H, Ins, C_9, PRGAAPGTSP, (SEQIDNO:7763); XM_547535.6, SMG5, Ins, C_9, PRGEQRARGEGPPYQAALPGCGGGCASTRPHPLQQNCLSRSV, (SEQIDNO:7764); XM_014120232.1, LOC106559875, Del, C_9, PRGLPRGPAAVPPPAARATGGSVGLQRRRAPGTRRTGGAAGQAPRTAHSPRGP, (SEQIDNO:7765); XM_540485.6, ARL16, Del, C_9, PRRGPRWAPT, (SEQIDNO:7768); XM_005622091.2, CASKIN1, Del, C_9, PRRPRRRAPAASWTTSAACSTTWPTSWTPCWS, (SEQIDNO:7769); XM_005631712.2, EPS8L2, Del, C_9, PRTRPPSPSSATAVTPQPARTGWARRCRSVSQASAVGSRRMRSPEPCWPRR, (SEQIDNO: 7771); XM_848355.4, PDZD4, Del, C_9, PSAMSIMTRRSSWRAARRRQTVWTSWSMRRWSCTRPATGTS, (SEQIDNO:7772); XM_014118661.1, C13H8orf82, Ins, C_9, PSASLRQRPGPRRASRAGGGTSWLLSPGPTFSTGLPVPGPRPGRSARQDHRRV, (SEQIDNO: 7773); XM_014110159.1, LOC106558165, Ins, C_9, PSGVLGGGL, (SEQIDNO:7774); XM_005634093.2, F7, Ins, C_9, PSLPHPGGSPGCPAPAKARQLVPGGAAGRLPGERVPGGAVLL, (SEQIDNO:7775); XM_014107494.1, RHOBTB2, Del, C_9, PSLWCPIPRPAARSAPPTSWRTRCVRMSYWCCRSGCASLPTRSTSPPRPPSSTTCSSW T, (SEQIDNO:7776); XM_005642172.2, RAB40B, Del, C_9, PSQLLEDSEGRPGSPLPGAGGRGSRSY, (SEQIDNO:7779); XM_014111415.1, LOC612200, Del, C_9, PSRAARAPRLPGAT, (SEQIDNO:7780); XM_540906.5, B3GAT3, Ins, C_9, PSRHPGSRVLC, (SEQIDNO:7781); XM_014118922.1, TEAD2, Del, C-9, PSRVWTSGRSMTSSQRKRVAFGSCTIAGPLTPSSWSSSGRTSTGARVARR, (SEQIDNO:7782); XM_005632764.2, WIZ, Ins, C_9, PTAGQEGQAEGRGYGQPLGEAGPLGRRSRRHFLGL, (SEQIDNO:7783); XM_005627098.2, ATAT1, Del, C_9, PTHTPSKSVFSLQEVAQAVPPNGCIPS, (SEQIDNO:7784); XM_005628317.2, GPT, Del, C_9, PTPRGRRRGRRCWRSWRQRRSSRSRCSTSPRASAATRCRAPCTPSLACSCPPAPCSAL RN, (SEQIDNO:7785); XM_003639258.3, DOC2B, Del, C_9, PTPRRKTRTPRVKIPTPPKIVLPWARWISACSTTRKTTPSTVPSARPRA, (SEQIDNO:7786); XM_014118308.1, PRRC2A, Ins, C_9, PTSQREPH, (SEQIDNO:7787); XM_536612.5, PELP1, Ins, C_9, PTSSPCAGPCGPAAATVGTRGDSWWRRTPCPGGRPDGY, (SEQIDNO:7788); XM_848028.5, ZCCHC24, Del, C_9, PTTCATCASTKDTTSRTVPRHAPKARV, (SEQIDNO:7789); XM_538915.5, FRS3, Del, C_9, PTTTTTTRALLSARPSPSAPMRTSVRGCGQGRAGD, (SEQIDNO:7790); XM_541409.5, ZNF628, Ins, C_9, PTWPSLCPSGHLHSSHLPDGTSGTHWRCTWRYDPTGPTLHPDCPDSARSPAGAYIL, (SE- QIDNO:7791); XM_014118661.1, C13H8orf82, Del, C_9, PVRVPAAAPGAAQGEPGRGRD, (SEQIDNO:7792); XM_014112383.1, ADAMTS17, Ins, C_9, PWARRHSLLGSQCGACCLREPALP, (SEQIDNO:7793); XM_014114181.1, RASA4B, Del, C_9, PWCAFSSSHHSVSLGSGA, (SEQIDNO:7794); XM_854614.4, MBD6, Ins, C_9, PWGTRPSPSPRRA, (SEQIDNO:7795); XM_014107007.1, DIDO1, Ins, C_9, PWPLRGPKGAASQSV, (SEQIDNO:7796); XM_005631712.2, EPS8L2, Ins, C_9, QGPGPHPLPALRQ, (SEQIDNO:7798); XM_005627098.2, ATAT1, Ins, C_9, QHTHLQSQYFHYRR, (SEQIDNO:7799); XM_014117108.1, LOC106559343, Ins, C_9, QLPHVQLPPSCPSTAPWLPGRTRQGKTGHSAPGPRRTASGHSHLTSSL, (SEQIDNO:7800); XM_848028.5, ZCCHC24, Ins, C_9, QLPVPPVLQQRTLHQGLSPGTPQRRGSDPVPGQKALFRRVQVSQVQEKMDERELLG QHGAGVH, (SEQIDNO:7801); XM_014121819.1, CAMSAP3, Ins, C_9, QPLCAAGPSGEEGHRARAARAPCAGGGPEAPAYPHGRPPPCSPDHPAAAGED, (SEQIDNO:7802); XM_003639258.3, DOC2B, Ins, C_9, QPPGGKPGPRGLKFRRLQKLYCPGHAGFQPALRPGKQRPPLYHQQGQGPEADGPQR ASRPLCQAASAARSQ, (SEQIDNO:7803); XM_014112276.1, COL4A3BP, Ins, C_9, RAGAGTPPFPAPRALTPAPGRFLRRGSGSGGWSPARLSRLHVG, (SEQIDNO:7804); XM_005638643.2, LOC102157171, Ins, C_9, RGHRPSPRAVRPPPGLWHLLRLQSGGREAES EEEGEGGWRPPEAPNSC, (SEQIDNO:7805); XM_014116237.1, BAHCC1, Ins, C_9, RLPPDATTSQRPVHFIRLPLWQPRARLQAARLRGQERGGLAGRSRPQCVGTRPACWI HLPCHDQLGLLHVPRRALF, (SEQIDNO:7806); XM_014120095.1, LOC102155747, Ins, C_9, RPRPLLPPRRPALLLGGSPRRQTPRGSRRNAEAAALLTRPSAPQNPDADGPPQGSLGV GLGAGRGHVGRGRSGTPTRAPAPEPQGGLLLGARK, (SEQIDNO:7809); XM_014109694.1, DONSON, Ins, C_9, RPRPRPRF, (SEQIDNO:7810); XM_005629431.1, LOC102155312, Ins, C_9, RQARPRRLPAVTHRAPGSCAR, (SEQIDNO:7811); XM_014119102.1, LOC102153462, Ins, C_9, RRRGPGAAAPGAASEDAARAAPGVRPGRPWVLPPRAGADPRPGRVIPVPSLDEA, (SEQIDNO:7812); XM_005628643.2, LOC102153462, Ins, C_9, RRRGPGAAAPGAASEDAARAAPGVRPGRPWVLPPRAGADPRPGRW ATDASRFAVPRTPPRPDDLRVIPVPSLDEA, (SEQIDNO:7813); XM_005642085.2, LOC102156583, Ins, G_10, ADGPRPLCSSPWPP, (SEQIDNO:7814); XM_014113210.1, LOC106558749, Ins, G_10, AVRGHWALLGWAEGLELGRPGRLGGPRAA, (SEQIDNO:7815); XM_532250.5, QRS1L, Ins, G_10, EGDRTLSTP, (SEQIDNO:7816); XM_014109665.1, LOC102154979, Del, G_10, GAAGGRVPGGRAHLGCG, (SEQIDNO:7817); XM_005642273.1, LOC102152155, Del, G_10, GAGARAHGRGTTATGQGASPLPAAAWTGHVAWRPPPHTPRGGGDRGGGVWRRGL TLPTGPTAPTRGGGRATPKGSLNLRAGTR, (SEQIDNO:7818); XM_014107649.1, LOC106557788, Del, G_10, GAPLLGPPACTQNPGC, (SEQIDNO:7819); XM_014118269.1, LOC106559574, Ins, G_10, GAQRGAGGA, (SEQIDNO:7820); XM_539574.5, ZFP69B, Del, G-10, GASSCCSSSSSPCPRRPARG, (SEQIDNO:7821); XM_014116262.1, LOC491550, Ins, G_10, GCRRPEGAGGRRGRRTSPRHPLVSWDLFFPHSGPSLPAKPRQQPAQGLCSQLEPFAR SWAANERVPAGARGHGRKGDRSSRGDSGAQW, (SEQIDNO:7822); XM_014121835.1, JSRP1, Del, G_10, GEGPARGWGGVS, (SEQIDNO:7823); XM_014117116.1, CPM, Del, G_10, GIQGRSPRVPQPTGAPEGGPASWGGGVQGAPEEPRPRGEEGCGEPPRSPGLVREEGP WHGRRRRQVLRAGRPPRRVGPPQPPGRPTPAA, (SEQIDNO:7828); XM_014109665.1, LOC102154979, Ins, G_10, GLRGAEFRGVEPTWAAAEVVSPGL, (SEQIDNO:7829); XM_014122482.1, LOC102152187, Del, G_10, GLSERGPPRRPFPSRVREPARPAVSRSSRRAEGHGLHLEKSFAFLLSLFKPLLSEPLEE AWFLLE, (SEQIDNO:7830); XM_003639170.3, SLC27A3, Del, G_10, GPAGKGRVPAHARSRGRG, (SEQIDNO:7831); XM_005642273.1, LOC102152155, Ins, G_10, GRAHAHTDAARLPPGRGRAPSRRPRGPGTWRGDPPRTPHGVAGTEAAESGGGD, (SEQIDNO:7832); XM_014107649.1, LOC106557788, Ins, G_10, GRPYSALQPARRTPGAESGGPRGRFWRAPTSQRP, (SEQIDNO:7833); XM_848566.4, SLAIN2, Ins, G_10, GRVGPPGDEQRPTSGSPLPAGGGRGRLA, (SEQIDNO:7834); XM_014113210.1, LOC106558749, Del, G_10, GSARPLGPAGVGRGSGAGQAREAGRASSSLTGDRGQGTGWLPPPTGQIRGALGQ, (SEQIDNO:7835); XM_848566.4, SLAIN2, Del, G_10, GSGRAPGGRTTTNFGKPPPCWRRARAACLTRWSRCGPTSWSGCRAGRRRRRAGCIH HQRKN, (SEQIDNO:7836); XM_014121826.1, LOC106560105, Ins, G_11, GCIISSPRWPSGSARSRCADDVSSTWASLGLFVLFSY APALFSGGLLRSRS, (SEQIDNO: 7839); XM_005635998.1, DTYMK, Del, G_11, GLLSGAPAAQTAGAASATRAAAASGPGEAPAEAASSGSRGFGSRPRPRTKGRPSAPR AAPLCSGPARPGPRLRSALCFLGR, (SEQIDNO:7840); XM_014121826.1, LOC106560105, Del, G_11, GJMYYFISQVAFRLSSIQMCRRCF, (SEQIDNO:7841); XM_005633247.1, C20H19orf24, Del, G_11, GPGAAPPSGSAAPRHPAWPRAASVLRGPGLPAGRQGPGVPPLGAGPERRRGRGRGG RGGRGRAGTARGLAGPRRRP, (SEQIDNO:7842); XM_541564.5, MARK4, Ins, G_11, GRGCAEWAPRLSHAGPRGHPPAHWAAPPHHQPLHQADLQTDQKGHRRT, (SEQIDNO:7843); XM_545270.2, LOC488146, Del, G_11, GRGQKNVLDSLIRLCLVSRGQKKIAESANFLISLKKM, (SEQIDNO: 7844); XM_014111178.1, LOC106558357, Del, G_11, GRPNRQKAPRTT, (SEQIDNO:7845); XM_014120239.1, SOS1, Del, G_11, GVRKDLREKGAQERGKELVPRSRDKFIRLLSLVTMLFNMLKN, (SEQIDNO:7846); XM_014110071.1, LOC100683502, Ins, G_12, ALGARAQGNGDPLI, (SEQIDNO:7848); XM_005619076.1, LOC102154314, Del, G_12, GCASGTRRAESALGKN, (SEQIDNO:7849); XM_005621522.2, NTAN1, Ins, G_12, GETWAPNVPSRLDYISHKAPAPAPGYF, (SEQIDNO: 7850); XM_014121838.1, BTBD2, Ins, G_12, GRGVGIARVRPPLATFLLEASASSARGRCVLCAGPGAPDSGPGTGGRAEGHQAPL, (SEQIDNO:7851); XM_005621522.2, NTAN1, Del, G_12, GRNLGAERSLAVGLHLPQGPRPRPRVFLARGEGPASRSRAAPGATP, (SEQIDNO:7852); XM_014110071.1, LOC100683502, Del, G_12, GSGSTGPGEWGPSHLRERTRREEDRPAEFMESAISGPLILRRGGVLGRGVGALPAGA ALRPPEGAAAPGSQS, (SEQIDNO:7853); XM_014120227.1, CMPK2, Del, G_12, GVSPSFLKLKQCSTWLTSARSRSRRGSSRSLSSKDWMPLVKPL, (SEQIDNO:7855); XM_005621005.2, CLDN15, Del, G_13, GASRDSLSSPACHSQCVSHLPR, (SEQIDNO:7856);

XM_005621005.2, CLDN15, Ins, G_13, GLP-GIPCPLQLATPSACLTFPV, (SEQIDNO:7858); XM_014106531.1, LOC106557613, Del, G_14, GARLAAHRRRGPGLWGPPLDATVRGPA, (SEQIDNO:7859); XM_542564.5, RCBTB2, Ins, G_14, GPKAELCPRVWK, (SEQIDNO:7861); XM_014111206.1, SRM, Del, G_14, GQARPDCHSPPARATATCWCWTA, (SEQIDNO:7862); XM_014111206.1, SRM, Ins, G_14, GRPGPTVTRPQQELRQRAGAGRRDPVHRAGRVLLPGD-DREPAAVQPPRPPQGADHR GRRRGRPAG-GAEALVRGVRGAVRDRRGRHPGL, (SEQIDNO:7863); XM_005619450.1, PWWP2A, Del, G_14, GTIRQTRTS, (SEQIDNO:7864); XM_542564.5, RCBTB2, Del, G_14, GTKGGALPSSLEVTPGPR, (SEQIDNO:7865); XM_014110360.1, P1D1, Del, G-15, GAMHLL-CREVAPGHCLPFQALPTSTTAACWEGATAK, (SEQIDNO:7866); XM_014110360.1, P1D1, Ins, G_15, GRCTCSAERLLQVTVSRSRLCQHQRPQHAGKARQR-NECACAGHGDGPFGHGRTGV PRWPLRPRP-PAAVLQGCPWLSF, (SEQIDNO:7867); XM_005623909.1, LOC102152283, Ins, G_16, DDAQGAAD, (SEQIDNO:7868); XM_005620429.2, MMEL1, Ins, G_7, AAAAAAPGDRRPGGPGP-PLCCQQQREAADTLS, (SEQIDNO:7870); XM_014115697.1, LOC102152805, Ins, G-7, AAAGSGLRGSAAG, (SEQIDNO:7872); XM_849768.4, FAM83E, Ins, G_7, AAAGSQPPPCGPP-PLCGPHVPAATRRPVGPTLGCLPSI, (SEQIDNO:7873); XM_005617274.2, PURA, Ins, G_7, AAARDAGAGLQAGGHPEQALLPGREAERQG-PLPEDR, (SEQIDNO:7874); XM_005638695.2, C2CD4A, Ins, G_7, AAGAAEPRAVGCRV, (SEQIDNO:7875); XM_543461.5, MN1, Ins, G_7, AAGAAGARILWR-PAAAPRPPGRPPPPPTSPPLWGQLRRPGPG-GLVPARGSPTWVRRR RRRPGQPAALRGGL, (SEQIDNO:7876); XM_014107348.1, AMER2, Ins, G_7, AAGAGRGSPGAPGRP-GAAPWGGPAGRRRPQPPQPRGPPRRLGRRRRRPRP, (SEQIDNO:7877); XM_850395.3, USF2, Ins, G_7, AAGCDPGGCGWGRPAPRPHCRLCAPRARSAL-PAGRNPKSLQQWRQPGS, (SEQIDNO:7878); XM_005626608.1, SIL1, Ins, G_7, AAGPQEPGTGQGHR-GAGRACGHSAL, (SEQIDNO:7880); XM_005629424.1, ZNF219, Ins, G_7, AAGSAAHAPRRGPRARRTCRG-GAGQARGAGRERAVSWRDSARRRPRSHGEGLPLL WKVFPLSASP, (SEQIDNO:7881); XM_539200.2, PYCR1, Ins, G_7, AAGSHHERRGGCHVPGQGAQQEV, (SEQIDNO:7882); XM_014118662.1, ARHGAP39, Ins, G_7, AALAQPAAVRAGARRPRVLPRAEAV-ALPEEGRAGELLPAAGAAAQSCRRLAAVVP T1R1, (SEQIDNO:7883); XM_014112681.1, DGKQ, Ins, G_7, AALRHPHRPGLLLPGHPSQGHARAGGRRAL-GAGPRAHDHLGRRPQGPHAQEDQAE AQEVRGPQGCPSRRGARP, (SEQIDNO:7884); XM_014108067.1, RNF152, Ins, G_7, AAPGGGGGGAR-QAGRGEKLHLVRGVHCDPCGLRPGLPPGHRAAQHVLHF, (SEQIDNO:7885); XM_543229.5, TRIM35, Ins, G_7, AAQLAGGRGAAAPGRRCRGPLAQLLPRHPLRLL-VRVPHAGGGGGPLRDLGPSHIAS GPGHPSPPAR-GAGV, (SEQIDNO:7886); XM_005617510.2, KIFC3, Ins, G_7, AARCGPHGA, (SEQIDNO:7887); XM_533246.4, NUDT22, Ins, G_7, AARGAGAG, (SEQIDNO:7888); XM_005631571.2, C18H11orf84, Ins, G_7, AARGREWHV, (SEQIDNO:7889); XM_014122123.1, CELSR3, Ins, G_7, AASCPVPG, (SEQIDNO:7890); XM_536856.5, PLOD3, Ins, G_7, AASPPGASGCVCRTIYPIPAPL-PAAAAAPGLPP, (SEQIDNO:7891); XM_844169.5, ARHGEF25, Ins, G_7, AAVLPRSRETCLPLRANCHLQ, (SEQIDNO:7892); XM_005630824.2, LINGO4, Ins, G_7, ACCFFLLWRRRPSPHCLLDEASGGLAGKGWE-SEGPRGWDAGDPLSAATGQRGLRL HGQQCRWE, (SEQIDNO:7893); XM_014115361.1, ADAM15, Ins, G_7, ACGHQLCPMLLRLPPLSAPSRGSWGPCRWH, (SEQIDNO:7895); XM_005622091.2, CASKIN1, Ins, G_7, ACRSWPRCGGWCHPAAVSRSSQG, (SEQIDNO:7896); XM_005620597.2, NOL9, Ins, G_7, ACSPSSRAGGK, (SEQIDNO:7897); XM_014116795.1, PHF12, Ins, G_7, ADGANPSSAGSPQDGRGRKAESEA, (SEQIDNO:7898); XM_014109646.1, LMANL1, Ins, G_7, ADLVGRHRDPLRLLGRGHPAEPCHPRAGQ, (SEQIDNO:7899); XM_005638627.2, LMANL1, Ins, G_7, ADLVGRHRDPLRLLGRGHPEPCHPRAGQ, (SEQIDNO:7900); XM_014118167.1, SPDEF, Ins, G_7, ADPGGALPGAGAVHGGGRGA, (SEQIDNO:7901); XM_535292.4, SLC12A3, Ins, G_7, ADQQDGPGEKSDHFPVEQVPTGIP, (SEQIDNO:7902); XM_005637247.2, IFF01, Ins, G_7, AEA-GAQGCHRGGHLPVGK, (SEQIDNO:7903); XM_005633056.2, UBXN6, Ins, G_7, AEVVGGGQPGLQRVRAGALGPPDLLVGRSCAR-RHQGGWGRTQLIYSETGAPGSHR EALM, (SEQIDNO:7904); XM_542952.5, HCK, Ins, G_7, AFELRRSGL-PAGGGAGAQDGVYEVQVSPGQRQGLKN, (SEQIDNO:7905); XM_005619991.2, EFNB3, Ins, G_7, AGAALAGRGRGWGCHVLA-ETAGQAFGESPPWSWLLREGRVSGPGQRKWH-GASGG, (SEQIDNO:7906); XM_005621751.2, CAPN15, Ins, G_7, AGACRAASGAAQRGGGGGGGLGG-GAAKGGGSREWLGLPALHAAQHAGGQLLLCL RGP-PETLAAQNTPRGPGGP, (SEQIDNO:7907); XM_535876.5, FL3A1, Ins, G_7, AGAPRSQPARLSS-CYKYSPVQGEMGHQ, (SEQIDNO:7908); XM_854895.4, SH3BP5L, Ins, G_7, AGDPAGGASG, (SEQIDNO:7909); XM_005624167.2, OTOP3, Ins, G_7, AGGALFGGL, (SEQIDNO:7912); XM_005621663.2, FLYWCH1, Ins, G_7, AGGPEAAGADPQPGPEGRLRSP-PASGVPEDVPWGQVPGVRVLPLQEGEGGGGEVL DVPGPGPAGLPQPGHHPGPAGDGDA, (SEQIDNO:7913); XM_003432153.3, EMILIN1, Ins, G_7, AGGPGQAAQCP, (SEQIDNO:7915); XM_845621.5, MLLT6, Ins, G_7, AGGQRGPAPQWAPGGVEWGCRPQPC-GLEPGWRGPHAAAARLS, (SEQIDNO:7916); XM_540483.3, TSPAN10, Ins, G_7, AGGRRSEPGRLPGCPL, (SEQIDNO:7917); XM_005623069.1, LRRC30, Ins, G_7, AGHA-LQLPEGQKAPL, (SEQIDNO:7919); XM_005638641.2, CSPG4, Ins, G_7, AGHRGLPPPPGTPPGPGLG-GRQRLPPGLHGGSQHQRPEAGAPGSLADSQHG-GRLQP GGRRVRGGHLRHL, (SEQIDNO:7920); XM_537179.5, PAPPA2, Ins, G_7, AGKPPGRTQ, (SEQIDNO:7921); XM_014108780.1, LOC106557931, Ins, G_7, AGLLYGIWTPALPSRAGVPAAALAQSAASR, (SEQIDNO:7922); XM_014112067.1, LOC106558506, Ins, G_7, AGPGPRGAEPGGGARSLTRAARPSARAPGGGG-GRSRPRGA11, (SEQIDNO:7923); XM_014116135.1, FAM181A, Ins, G_7, AGPQGGTSL, (SEQIDNO:7924); XM_005620316.2, PLD2, Ins, G_7, AGPRLRPLG, (SEQIDNO:7925); XM_005621134.2, ZNF316, Ins, G_7, AGRARGSG, (SEQIDNO:7926); XM_005623080.2, MTCL1, Ins, G_7, AGRERGWCRAFP, (SEQIDNO:7927); XM_003435111.3, NFATC4, Ins, G_7, AGRGFRGGG-GRPCSRMPQHPHHLHLSHA, (SEQIDNO:7928); XM_014122369.1, FBN3, Ins, G_7, AGRGR- GRPSVRGHPRAQHLLWSPGAGLLRP-PLPWRGHQIRVLLC, (SEQ ID NO:7929); NM_001286967.1, ARHGAP18, Ins, G_7, AGRQGAGGGHVQP, (SEQ ID NO:7930); NM_001145174.1, CA9, Ins, G_7, AGRVGRL-SAGGSRRKQCL, (SEQ ID NO:7931); XM_014107657.1, GPC1, Ins, G_7, AGSCGRRGCPDLGHGGLEL-PRWGRRGQPWMPPRTKSLCAVSSYAFVY, (SEQ ID NO:7932); XM_014111418.1, LOC106558412, Ins, G_7, AGSLQAPDDLLGRLCALGPGWAPG, (SEQ ID NO:7933); XM_005635420.2, UFM1, Ins, G_7, AGVARPRAS-RRRRRGCRSAGLHDVEGFL, (SEQ ID NO:7934); XM_014118775.1, LIMCH1, Ins, G_7, AHGGTSSPVRRQRCRRSPEAPTAGASWDQSEA-GGAALCQSQAVQ, (SEQ ID NO:7935); XM_014115724.1, CEP170B, Ins, G_7, ALAHAPGL-RAALRQCGTPLPSGPGLHGAVPAGGLPGRPARP, (SEQ ID NO:7937); XM_537686.5, COIL, Ins, G_7, ALAPGRERAPGTRQRLPQS, (SEQ ID NO:7938); XM_014117279.1, TRMU, Ins, G_7, ANERFCQENSC, (SEQ ID NO:7941); XM_014114446.1, MSLN1, Ins, G_7, APAAAQRL, (SEQ ID NO:7942); XM_014120227.1, CMPK2, Ins, G_7, APA-PAPGPSFYIPVAQGPAQTRPGSAAHSESRGEDA, (SEQ ID NO:7943); XM_843818.3, LST1, Ins, G_7, APAPGCAHSVRLSVSASSESEEAGEELGPALRARAPL-RISAAHALP, (SEQ ID NO:7944); XM_005618879.1, PRF1, Ins, G_7, APEGSGLGPRLWLG, (SEQ ID NO:7945); XM_539851.4, EPHA1, Ins, G_7, APGCE-VQRGVFTVPGSSGGRGALPALRGKCALFPRSQRAH-GASRARQRP, (SEQ ID NO:7946); XM_860329.4, KLHL42, Ins, G_7, APGPSPLPRGAPVHAQV, (SEQ ID NO:7948); XM_849651.4, RINI, Ins, G_7, APGRWGLQGQSQSRGQQRRV, (SEQ ID NO:7949); XM_005639039.2, C31H21orf58, Ins, G_7, APGSGGFSAAGAPCR, (SEQ ID NO:7950); XM_014121604.1, FRMD4B, Ins, G_7, APLSWKQWGLQSFCGRPGRWLR, (SEQ ID NO:7951); XM_014112188.1, LOC106558557, Ins, G_7, APPAAETH-LLCRLHDPALLLQLPGVHRMRAPGLHGLR-PLRGHLPPPALPSHHDHGA LRPAGGLLLRQRLLH-LYDQGVLCLQGHLLWLQRPEPLLL, (SEQ ID NO:7952); XM_543313.3, OR12C12, Ins, G_7, APPAAETHLL-CRLHDPALLLQLPGVHRMRAPGLHGLRPLRGHLPP-PALPSHHDHGA LRPAGGLLLRQRLLH-LYDQGVLCLQGHVLWLQRPEPLLL, (SEQ ID NO:7953); XM_014109156.1, LOC491694, Ins, G_7, APPLRGACG-GAARGRVGHRV, (SEQ ID NO:7954); XM_005640594.2, PIKFYVE, Ins, G_7, APRTRYSQQFGRCV, (SEQ ID NO:7956); XM_005630590.1, ADI1, Ins, G_7, AQAGGLGDP-PRPPCGAQASSAAAVGC, (SEQ ID NO:7957); XM_847033.4, FSD2, Ins, G_7, AQCKERPRD-DLHHWQLLSPE, (SEQ ID NO:7958); XM_014122252.1, ABCA7, Ins, G_7, AQCPQNADQPGKADAN-TERRRQSSPASTQRPSARPTTP, (SEQ ID NO:7959); XM_014116304.1, OTOP2, Ins, G_7, AQPSPC-SAHDCPAHLPECVHHREPPSGTTRG, (SEQ ID NO:7960); XM_014107187.1, LOC106557718, Ins, G_7, AQRGGEGAAGRDPPGAPSLRNQGAAARAPP-PARVPAHQVGK, (SEQ ID NO:7961); XM_014107007.1, DIDO1, Ins, G_7, AQRSSTTPV, (SEQ ID NO:7962); XM_546502.5, MPZL2, Ins, G_7, ARA-VCVLLPCGSLQTHEWAFQGSGGLGREP, (SEQ ID NO:7964); XM_014120943.1, NAALADL1, Ins, G_7, ARCGT-PIRSLRSPGNPTGPPGLCQPGNRRRFHEATGSGHQIR-RHHRADPIWGHRTWG QGCQRCQTWGRWGVGVHGPRRHQ, (SEQ ID NO:7965); XM_014121803.1, PALM3, Ins, G_7, AREQPLRGHRRGGQGPKGCTDQLT, (SEQ ID NO:7966); XM_543945.5, TLL2, Ins, G_7, ARGALG-GRPGLLGAGRRGRRGAAAGALPRPVQSRCLLGRY-CLR, (SEQ ID NO:7968); XM_005621756.2, PDIA2, Ins, G_7, ARGGAPRGGEGP, (SEQ ID NO:7969); XM_541952.2, NXNL1, Ins, G_7, ARGGGRRRGPVL, (SEQ ID NO:7970); XM_539681.5, SLC39A2, Ins, G_7, ARLGPGCVRRRGCRHLSVRHLPRSSAPGTGQPRGP-SAQVGLCSCRVRLHGLHRLVG L, (SEQ ID NO:7972); XM_005638718.1, MAN2C1, Ins, G_7, ARPAGVSQP-GARGAAAHQRPPAVPTDPQSEGVWRK-GRASTFRSTAMAVLQMVDLL VSGGA-DHPGGMGGSGSSPSLGK, (SEQ ID NO:7973); XM_014121804.1, CACNA1A, Ins, G_7, ARPERP-PLLPTGPRWRPDGS, (SEQ ID NO:7974); XM_005629742.1, C16H7orf73, Ins, G_7, ARPRPHSPCRP, (SEQ ID NO:7975); XM_005629656.2, ZNF775, Ins, G_7, ARRAPPVHLQRVRQELLL-VVGAHHPPAHPHGRAALSVPRVRPPLQPEAQP-DAASAQ PHGRAALPVHRVRPRL, (SEQ ID NO:7976); XM_014108419.1, MAP3K12, Ins, G_7, ARRGTLSLG-GLPSSPAWAPPRP-PATQDVFIVPGSAVSSTGSPGPRGHRGSRGSWLTTS SPGRHPAK, (SEQ ID NO:7978); XM_848174.4, NAT8L, Ins, G_7, ARRVHPRVPRGRAGGGAPHLLR-RHHGAHPQHGLPRPAAAPAHAAALRPAGRALFC PDPLAAADVPGASRAAGPALLLQPEGGPGLPGLR-FAHGHG, (SEQ ID NO:7979); XM_534578.5, SFTPC, Ins, G_7, ARSPAAPGPAGACGHHCHLLHWLHWHRSV, (SEQ ID NO:7980); XM_859534.4, WNK3, Ins, G_7, ARVPSTVGRNFRNTTTVCSNSYSIWGTIPARNEFT-GISSFISAESICNPSWSQM, (SEQ ID NO:7981); XM_547829.5, TMEM260, Ins, G_7, ASCPGGAAALRGPARRLGRVRRRGRRVHPHAAP1G-AGGRLGGTDHSRT, (SEQ ID NO:7983); XM_005621587.2, UBN1, Ins, G_7, ASEGASPEA, (SEQ ID NO:7984); XM_014107808.1, LOC478038, Ins, G_7, ASILLCLHRLRHRHPICIVLL, (SEQ ID NO:7985); XM_014112419.1, POLG, Ins, G_7, ASLREGAS-RTVRQG, (SEQ ID NO:7986); XM_014113773.1, GLIS1, Ins, G_7, ASQAGPAWPHHGEPRGQFAA, (SEQ ID NO:7987); XM_003435196.3, MRC2, Ins, G_7, ASQSLLI-LQCQSSCPALEVGLPESALQPGHHAVPGHR-LAGYQHHSIPGHVRV, (SEQ ID NO:7988); XM_014113182.1, JAK1, Ins, G_7, ASRSLHAPEK, (SEQ ID NO:7990); XM_005627636.2, MDN1, Ins, G_7, ATA-SETDVKGQGRN, (SEQ ID NO:7991); XM_005632929.2, ARHGEF18, Ins, G_7, ATASTQPGGNGDTAWT-SHRRNG, (SEQ ID NO:7992); XM_843844.3, ADAMTS2, Ins, G_7, ATGPGHRGPAGQPG, (SEQ ID NO:7993); XM_014114365.1, SETD1A, Ins, G_7, ATPAPYTPFTP-FLRTPK, (SEQ ID NO:7994); XM_849704.4, CECRI, Ins, G_7, AVGADPTGRAGQREAHGPQEG, (SEQ ID NO:7995); XM_014115762.1, CDH24, Ins, G_7, AVGQHYSD-SHPQRRQRQPPQVASEPLPVLCGGNNGAR-HPGGPAAGPGPRPGGQCPH GI, (SEQ ID NO:7996); XM_545627.5, CPS1, Ins, G_7, AVHWSGRRI, (SEQ ID NO:7997); XM_005632803.2, CC2D1A, Ins, G_7, AVQDGSGTGHSPAEAGRPGDSMRGPGDP, (SEQ ID NO:8000); XM_005636303.2, MSI1, Ins, G_7, AVSEHHGGGREAIF, (SEQ ID NO:8001); XM_546604.4, ALOX12B, Ins, G_7, AVSQGHVPGSARLC, (SEQ ID NO:8002); XM_014114800.1, COL11A1, Ins, G_7, AWFIWCQR (SEQ ID NO:8003); XM_014106951.1, RTEL1, Ins, G_7, AWGLSVLGSHPP, (SEQ ID NO:8004); XM_005629104.2, B4GALT2, Ins, G_7, DAGARVQGRAPSLPAALSRGRHPLL, (SEQ ID NO:

8005); XM_535200.5, PITRM1, Ins, G_7, DDRVAPRAARRRASGHVRAGCAFLIFLP, (SEQIDNO: 8007); XM_014111291.1, CD84, Ins, G_7, DGCFTGAPCRGGASE, (SEQIDNO:8008); XM_014112349.1, BOD1L1, Ins, G_7, DGGLGCGPPSPPVGRGWRTGGRRDGSGRMRPGVRGARRRGRGESAGRFLAWEEGL RGEGLCAKCQSESGACLPEPEATC, (SEQIDNO:8009); XM_539968.5, ADGRA2, Ins, G_7, DGGPRGGGAGAHGLLGHPCPPPPN, (SEQIDNO:8010); XM_005616884.2, MAP3K10, Ins, G_7, DGQGVGHDPHGARLDRGVRLRGGGR (SEQIDNO: 8011); XM_014118260.1, KHDC1L, Ins, G_7, DGTRLVAFWGTGEGGPGTLAGHQPLPWACAGTLGVVTGDQRGAEW, (SEQIDNO:8012); XM_532946.5, COX7A2L, Ins, G_7, DHLLPDCSLHGFAAQKQM, (SEQIDNO:8013); XM_547113.5, ABCC6, Ins, G_7, DLDRRGPHRTRGAAHAALQNHHHPPGPHAVPRLSADEPRHAGRAHG, (SEQIDNO:8014); XM_005620375.2, SCNN1D, Ins, G_7, DLPASSPTTLPGALAGVLAEEL, (SEQIDNO:8015); XM_005619566.2, FLI1, Ins, G_7, DLPQPQRAPPP, (SEQIDNO:8016); XM_541795.5, BHLHE40, Ins, G_7, DLQETIRPGSQSHGLQGETQLPGQRL, (SEQIDNO: 8017); XM_005636656.1, LOC102153039, Ins, G_7, DLSRSPLSCGQGSPASGVEGRRSSRRRNLSSHQAADHRGPRAPSRQVPPSHQVPVLSG DPPLAPEDQ, (SEQIDNO:8018); XM_539687.3, LOC482570, Ins, G_7, DNPLHIADLPHHHAALLWS, (SEQIDNO:8019); XM_005627365.1, PTCRA, Ins, G_7, DPALPAPQRAGRCTAVSRSLRPQARPQPPPPALAAVGGTPGAPEPRLGGGEALYPPS LGLVLV, (SEQIDNO:8020); XM_014119273.1, LOC106559736, Ins, G_7, DPGGLPQPQRNRKTWEEQNLEPRRRDCPGRRGPGRAGDAA, (SEQIDNO:8021); XM_844620.4, C5H17orf74, Ins, G_7, DPGQPATSLSLPLP, (SEQIDNO:8022); XM_539219.5, FOXH1, Ins, G_7, DQQAPTPFP, (SEQIDNO:8023); XM_014111086.1, MDH1B, Ins, G_7, DRGAHKAFQDSVSSCSPRPKLSVRDPGPRAQFTVRLRHAVVARKPPRRDSCPRGGF NMAKFVLAGVVKRSV, (SEQIDNO:8024); XM_014108010.1, MYO18B, Ins, G_7, DSRDSSWPPGQH, (SEQIDNO:8025); XM_005616462.2, PVRL2, Ins, G_7, DTAGAAAASCWGVLGLHLAEGEEEKEEPWRRRRRRRRRRRRQQWRRILRSKNSGV WEWGPSLLDTNRPWSPEARRQG, (SEQIDNO:8026); XM_014116586.1, LOC612190, Ins, G_7, DYCSWDAGTL, (SEQIDNO:8027); XM_005629015.1, LOC102155600, Ins, G_7, EAGPHLPTP, (SEQIDNO:8028); XM_014106386.1, LOC102156659, Ins, G_7, EAGRGAGAALFYARGVSRQPGGSKTLRENRVFPPGR, (SEQIDNO:8029); XM_014109693.1, LOC106558086, Ins, G_7, EARGGAELRAGRAAGAAPSLAARTRAAASAGTSSGFRASRPDLSRFSATWQPARPP PRGKSMEQSVATSPWSV, (SEQIDNO:8031); XM_541606.3, LOC484492, Ins, G_7, EASPWSHTNTLPGECAASPY, (SEQIDNO:8032); XM_005642072.1, LOC102152098, Ins, G_7, EDAAGAAGGPVAEDGCGEPVRQR, (SEQIDNO:8034); XM_014118249.1, PGC, Ins, G_7, EDGGPEHPGLQLAVRPQ, (SEQIDNO:8035); XM_005619697.2, LOC102155606, Ins, G_7, EELRPESLRRPLWGTQV, (SEQIDNO:8037); XM_014107187.1, LOC106557718, Ins, G_7, EGAAGRDPPGAPSLRNQGAAARAPPPARVPAHQVGK, (SEQIDNO:8038); XM_014110158.1, LOC106558164, Ins, G_7, EGEEQAGAEKKSWKGKEPALFPHFWLPFRGQCPRTPLPLQPHPRALLASLSSSLPVA RSPETVSDTPVSV, (SEQIDNO: 8039); XM_544572.6, MASP2, Ins, G_7, EGHGEHALRWLRRWGQGQLQRGQWGGISVSRQ, (SEQIDNO:8040); XM_005623182.2, TSHR, Ins, G_7, EGVSFSPL, (SEQIDNO:8041); XM_005620976.2, FKBP6, Ins, G_7, EHAEPKGPARGQRFRPVTV, (SEQIDNO:8042); XM_005616334.2, BCAT2, Ins, G_7, ELWAHSTCAARGEEEGL, (SEQIDNO:8043); XM_005624150.1, CBX4, Ins, G_7, EPGRRAPR, (SEQIDNO:8044); XM_014117924.1, LOC481671, Ins, G_7, EPHLQCRGWWTCPSRTSPPTTTTTKPH, (SEQIDNO:8045); XM_005628380.1, CPA1, Ins, G_7, EQTPCHLDRHRHPFPGVGHPGQRGLVCKEDHTRLWPGLHTHSHS, (SEQIDNO:8047); XM_003431951.3, HIVEP3, Ins, G_7, EQTRPFTSWQP, (SEQIDNO:8048); XM_005617189.2, WDR37, Ins, G_7, ERGREGAPSL, (SEQIDNO:8049); XM_005630224.2, KIF3C, Ins, G_7, ERQDHHGGHSGASFSQLRREPLHPALCQQGQEHQEQAPGERGSQGHAAAGIPGGDR PPEGPAGEEGDAGKAAPEEEQPQEEGCVGPGWVPGGVSDRGLGG, (SEQIDNO: 8050); XM_535078.5, LYN, Ins, G_7, ESAASKANRLFCPDCRGNGIHREKELHPPRSTSSKRSGF, (SEQIDNO:8051); XM_014112781.1, ANTXR1, Ins, G_7, ESCPGRFHELPGSQLLLCGPLLSCYClHEGAQGDPSLWKRGVP, (SEQIDNO:8052); XM_014118297.1, MDC1, Ins, G_7, ESGQLSGRGFPLGD, (SEQIDNO:8053); XM_005627533.2, SLC17A5, Ins, G_7, ETAARIWDPWHCCLYPVHSHCCRFWSWSPHCTQGTRRIRRGCYISSYACHVVFMGS PS, (SEQIDNO:8054); XM_014117000.1, HMCN2, Ins, G_7, ETADREGGPKG, (SEQIDNO:8055); XM_8475 1 7.4, C25H2orf57, Ins, G_7, EVPRLQPLHGQRGGQLYALHDQPAGRRRGVHQLPGRRPRVV, (SEQIDNO: 8056); XM_005641746.2, LOC102154334, Del, G_7, GAAATAAATRRRRRSPRSSRTRPPQPPRGRSPRTRSSASSAACSPGWS, (SEQIDNO:8060); XM_846765.3, TRIM65, Del, G_7, GAAATRRAPSAGSPSPTWPSCAEMWRSAPCSR, (SEQIDNO:8061); XM_543686.5, WNT1, Del, G_7, GAAATTSTSAASSAGSLWTPGRRGGTCASS, (SEQIDNO:8062); XM_849485.4, FAM209B, Del, G_7, GAACVPALAAPALEAAPGRPPGAS, (SEQIDNO:8064); XM_540228.5, EGR4, Del, G_7, GAADLGSPAALWRSEEPPPEAGPGEQGRLGPPTPFPEVSTWSQQPRCLGL, (SEQIDNO:8065); XM_548143.3, PNMT, Del, G_7, GAAEGWGEGGRRARAARTRPECLPLGH, (SEQIDNO: 8066); XM_003639488.2, NUPL2, Del, G_7, GAAEIKKSHLLVPSILELQLAGTGGLDCPRTHLLHPVLMGRKMKRNFWKEL, (SEQIDNO:8067); XM_014107257.1, ARFGAP1, Del, G_7, GAAGRAEPRPPRRLRRRPCRLTRAGTTRTG, (SEQIDNO:8069); XM_005630590.1, ADI1, Del, G_7, GAAGRLRGARW, (SEQIDNO:8070); XM_014107476.1, HAND2, Ins, G_7, GAAGRRAPGPRGAAPGEAPGHR, (SEQIDNO:8071); XM_542654.5, NALCN, Del, G_7, GAAGRTPRTPGSPRGRSDSGGCPQHQNQ, (SEQIDNO:8072); XM_014118917.1, WNT16, Del, G_7, GAALMMSSMACGSAESS, (SEQIDNO:8073); XM_005616826.1, LOC102153346, Del, G_7, GAALPAAPRARWITHSASVRSAPAPSPPDCTAPRATPGGGCGQRSPDPSTPGLA, (SEQIDNO:8074); XM_005616764.2, LOC102156806, Del, G_7, GAARPPEGPAAAAHRSRTPRAPGPHQSQPRP, (SEQIDNO:8075); XM_014107943.1, SGSM1, Del, G_7, GAARQRSTARWTVGTISQKSPRWKVSSLPWLL- WPWPLLPTMRRPLCLPAASPTLQS SWTCTR, (SEQIDNO:8076); XM_005622125.1, SYDE2, Del, G_7, GAARRGLPLSPELRSLAAQTHLPLTARPPSAA, (SEQIDNO:8077); NM_001025398.2, SCN1B, Del, G_7, GAAWRWTQRPRPCTG, (SEQIDNO:8078); XM_005616765.2, PEPD, Del, G_7, GACATAPTPASVAVVRIQLCCTTDTPGPPTTGPSRMETCACSTWVASITASLLTSRAR SRPTASSPRTRRPSMRRCCGAAVLS, (SEQIDNO:8079); XM_014110527.1, LOC106558240, Del, G_7, GACELRGAAPGPAGSPPTRVDLWTPSTPVAGSGLGRRFSGCSGRARPRSPAAPPRQT R, (SEQIDNO:8080); XM_014107657.1, GPC1, Del, G_7, GACGAQGRAHRRLCGPAALWGAGGGSGRSA, (SEQIDNO:8081); XM_538028.5, TIMM17B, Del, G_7, GACSPPSTVAWCACGAKKIPGIPLPAEH, (SEQIDNO:8082); XM_014119127.1, LOC102151792, Del, G_7, GACSPSTPRAAWGTRWVSTPPFTPWPR, (SEQIDNO:8083); XM_014111997.1, LOC106558481, Del, G_7, GAEARRRAGP, (SEQIDNO:8085); XM_546956.5, NYAP1, Ins, G_7, GAEQGLWNGGPVPHGQDPAAGARDRRGCLCQHLLRPCHRQCRDTRGGRRGDGRC DIWGRLGSAEEGPVWREEGKRAGHRGRGWCPGLEWQCRGSRQGGA, (SEQIDNO:8086); XM_005621046.2, NYAP1, Ins, G_7, GAEQGLWNGGPVPHGQDPAAGARDRRGCLCQHLLRPCHRQCRDTRGGRRGDGRC DIWGRLGSAEEGPVWREEGKRAGQGRGWCPGLEWQCRGSRQGGA, (SEQIDNO:8087); XM_014119242.1, LOC106559725, Del, G_7, GAEWGWPEPGSE, (SEQIDNO:8088); XM_005631271.2, LRP4, Del, G_7, GAFCGIMYA, (SEQIDNO:8089); XM_843553.5, FAM171A2, Del, G_7, GAGARRRSAARSPSRCCSTSPPWRSSTGSCRL, (SEQIDNO:8090); XM_005625992.1, SLC9A2, Del, G_7, GAGGFVTSQAQW, (SEQIDNO:8091); XM_014117996.1, C11H9orf152, Del, G_7, GAGGGKRRPRGPSKCQKPGGRLSSRDACVRGGGCSLGALPTGSPPRLRTPRRQL, (SEQIDNO:8093); XM_005616888.2, CAPN12, Del, G_7, GAGGQQERGARRGGGASPSALSFCHSSSATGGA, (SEQIDNO:8095); XM_005630590.1, ADI1, Del, G_7, GAGGRPWGPPATPVRSAGLLRSGSWMLTNMRMIQN, (SEQIDNO:8096); XM_014111404.1, FRMPD3, Del, G_7, GAGLRSLRHQCPASRGGRGTESP, (SEQIDNO:8097); XM_014111629.1, ARHGAP6, Del, G_7, GAGPALRGPACAARPTSGAAEGRSRPHPRQSST, (SEQIDNO:8099); XM_014114474.1, LOC106558921, Del, G_7, GAGPLLLPGGRTEDTRTASGASCWLGICHQGASSSSPTSECPPGP, (SEQIDNO:8101); XM_537253.5, MTX1, Del, G_7, GAGPRGGGRKRRGRCFRARGRARWRRPWSCTAGRGAGGYRQWTWTAWPC, (SEQIDNO:8102); XM_005620069.1, CDRT4, Del, G_7, GAGRDQNKVFGPSV, (SEQIDNO:8103); XM_014120406.1, GPAT2, Del, G_7, GAGRGAYPYLNY, (SEQIDNO:8104); XM_005625164.1, PPP1R26, Del, G_7, GAGRPVSSAHP, (SEQIDNO:8105); XM_541952.2, NXNL1, Del, G_7, GAGRRAAPGTCS, (SEQIDNO:8106); XM_014119253.1, LOC106559727, Ins, G_7, GAGRSAANSERAVPSAGSVRPAPNCGGRRACPGPRVPRSWAALGCAALRGRGAGR PNVPRGPGGRGRDRGRSS, (SEQIDNO:8107); XM_003431554.4, LOC481426, Del, G_7, GAGSACGTSRNRTGTTGRAA, (SEQIDNO:8108); XM_537674.5, MYCBPAP, Del, G_7, GAGSPGCRAASLSPVPRRRVTQSRPGRHHEVSKEGVPPQNVYSQILGGRRSL, (SEQIDNO:8109); XM_003638869.3, ZNF367, Ins, G_7, GAGTAAAAHPHQPRLQRLHGVPVALGRERAQRDAQPRGRGGRRLGRLARRRRAPG TPKPGRAPARRLGR, (SEQIDNO:8110); XM_014119531.1, CCDC61, Del, G_7, GAGVEAVLPAPRPRPQVVACHVSTPQPL, (SEQIDNO:8111); XM_005632677.2, HOMER3, Ins, G_7, GAHQSSPGARCPPGAPKSPRQRQWPRRRETVP, (SEQIDNO:8113); XM_014121988.1, WIZ, Del, G_7, GAKRPMNSRSWRRCGSPRPGSGRSPPWYPGPPRHHWSSLLATSTPSSAGSVRWNSR GPSLSRRSGCGTYSGTSWR, (SEQIDNO:8114); XM_014121817.1, LOC106560102, Del, G_7, GALHTRGAGAGTCWLWLRASSSSVRQALMGLWCPSLTFPHMKIPHG, (SEQIDNO:8118); XM_005639814.2, MASP1, Del, G_7, GALKNVAASRSMGSTQRSPTMWTGCGNRWAPHKVWGTSKWNG, (SEQIDNO:8119); XM_014117894.1, ABCA1, Del, G_7, GALPTCKMWWSRRSSGC, (SEQIDNO:8121); XM_543042.5, KCNB1, Del, G_7, GALQLLSLDWSVPHSWTGLY, (SEQIDNO:8122); XM_003432584.4, SAMD4B, Del, G_7, GALQSWALGRLGQAGRTSHPGKMDMCPSTHPAQCRQPSTVLGATQMQVSLAKFTP AR, (SEQIDNO:8123); XM_014120042.1, MEGF8, Del, G_7, GALTAACRSAQPTAAAMAPVPRPWDHAVVSLASWDVPVTCTCGRTRALAGGTM, (SEQIDNO:8124); XM_540302.4, ADAMTSL4, Del, G_7, GALWAIRRSC, (SEQIDNO:8125); XM_014114011.1, ZNRF1, Ins, G_7, GALWPLHPRLPGHRRLGEGARRRRVCVRLHLCPWQWLPGDRRRSP, (SEQIDNO:8126); XM_845262.3, ITGA10, Del, G_7, GALYCGSKRVTTFSPHGQPWKMSSPLLSRTMQPTWVTLFPPCFCGVDAASFSQGLL GLDTEERSSPSSLRKMGL, (SEQIDNO:8127); XM_014117418.1, CELSR1, Del, G_7, GAMGSRIRPLSPGLPRGITATTPTRIASCPWMSRAAHTPPPTRQTVRTMGWRLRTNG TQLGALSTAPPKWMPQPTTSRPAGPTRAWRGATARSLETSRA, (SEQIDNO:8128); XM_003431951.3, HIVEP3, Del, G_7, GANASFHQLAALNSPWRPSSKKG, (SEQIDNO:8129); XM_532155.4, AARS2, Del, G_7, GAPAAGRSHPSPLRPRPPPCETPS, (SEQIDNO:8130); XM_549367.5, IRAK1, Del, G_7, GAPARSRAGAVAQGPS, (SEQIDNO:8131); XM_014114417.1, XYLT1, Del, G_7, GAPASCPHTCRACETSWR, (SEQIDNO:8132); XM_548229.6, EPX, Del, G_7, GAPCHWLLFHFRSRPMIPASGTRGTASPSSARHPHAPRTGTKSETSSTRSPPSWTPAW CTAARTLWPLGFET, (SEQIDNO:8133); XM_014116184.1, MTA1, Del, G_7, GAPCPPSSGGG, (SEQIDNO:8134); XM_843371.3, LOC606890, Ins, G_7, GAPERSSRYHHRDQHPR, (SEQIDNO:8135); XM_014113853.1, SKI, Del, G_7, GAPGAATAPAERPSGGRGRAAPSGAERHRAGPSGAERGRAAPSGAERGRVPGGRGR AEPNRGRAEPSSWRAGPKAAESKRAAGCRRRWSSST, (SEQIDNO:8136); XM_014109910.1, KHDRBS1, Del, G_7, GAPGPRPPRSHHRCCRPRPRAPTRRWAVRRRPRCCPPQPLPPSRWSRRTSTCPNSWP RRTRSTRPSLTPCSY, (SEQIDNO:8137); XM_005636328.2, ACACB, Del, G_7, GAPGWSWTPPSTPCA, (SEQIDNO:8138); XM_005627166.1, EHMT2, Del, G_7, GAPIEEEVGPGAYSLFPEPRRPGLPNFLAG, (SEQIDNO:8139); XM_014116165.1, KIF25, Del, G_7, GAPPAAEPRPGPRGPSSPRSRCMPSCSSWTWRVASVQNIHCTSSPCGWVFARS, (SEQIDNO:8141); XM_005634379.2, PLCL2, Del, G_7, GAPPAGPCPPPRARPSAPRAP, (SEQIDNO:8142); XM_014122402.1, C2CD4C, Del, G_7, GAPPRPTGVTGCPGRRRGPS, (SEQIDNO:8143); XM_014107553.1, DGKD, Del, G_7, GAPRKMTLLQLRRLMIRSWRWLLCLAVCRWPSLVSLSCSITESPSVAR, (SEQIDNO:8144); XM_014112772.1, LOC106558673, Del, G_7, GAPRPVQVGVTGRGRGRERLSRRRSPRAGYGAVPAKARGYPRRCFLRPRKICLLS, (SEQIDNO:8145); XM_005620295.2, ADAMTS15, Del, G_7, GAPRTPGSRGSFCRSQRSGRTFTST, (SEQIDNO:8146); XM_014118740.1, EEF1D, Del, G_7, GAPSWFRWAMASASCRSSAWWRTTRWGQTCWRRRSPSSRSTCRVWTLLLSTRS, (SEQIDNO:8147); XM_014116133.1, UNC79, Del, G_7, GAPTPARRKKKQLSVTYVSLVFSAISLLVNSWRDWLLKKKAGWWSPQTVLRIASFLPDQTSL, (SEQIDNO:8148); XM_541408.4, ZNF579, Del, G_7, GAQEPLGRPCPAQPVAASSASPTTSPATG, (SEQIDNO:8149); XM_005619042.2, ZSWIM8, Del, G_7, GAQGLSRLQWQRQQ, (SEQIDNO:8150); XM_014112419.1, POLG, Del, G_7, GAQNQKCSISWRALPCLTPHVPRCWAAASAAPWSPRLSRGSL, (SEQIDNO:8152); XM_014116358.1, LOC102156823, Del, G_7, GAQRHVRSGSL, (SEQIDNO:8153); XM_847877.4, NUTM2F, Del, G_7, GAQTLQGRRPSLGPTSGALGSRPRPRPWGRFTPHSLQREGVTPFRWGAGGSATAAS, (SEQIDNO:8155); XM_005629920.2, HTRA4, Del, G_7, GARAAARRGRRCAAATGAPTPACASCAPRTARRVSGARSRPCRC, (SEQIDNO:8156); XM_014120956.1, NRXN2, Del, G_7, GARAAPPPWPGP, (SEQIDNO:8157); XM_014117074.1, LOC491341, Del, G_7, GARAARPAPTPAAPRPVPAAAATRAPTAASSAAARPPPA, (SEQIDNO:8158); XM_014116485.1, RSAD1, Del, G_7, GARAHAAPLPSFRRRGPAGRAPRAPVRPGRVSAASPSPGAVALLGAAPTWRLAAP, (SEQIDNO:8159); XM_003639503.3, COL8A2, Ins, G_7, GARAPGGAWAPR, (SEQIDNO:8160); XM_847007.4, HGH1, Del, G_7, GARARARRGAGCLPQRRGCRRPARRRRWRRCCPSWRPGPGRTCGPRRCGTCWR, (SEQIDNO:8161); XM_005617189.2, WDR37, Del, G_7, GAREGGGSESLTGVLSFLRTL, (SEQIDNO:8162); XM_849651.4, RINI, Del, G_7, GAREMGPSRSKPVPRTAEESLRQLLKGPREVWARPGRALLSQGGQRLRQQRS, (SEQIDNO:8163); XM_014109869.1, COL18A1, Del, G_7, GARGAGELGGPSRSRR, (SEQIDNO:8164); XM_005620976.2, FKBP6, Del, G_7, GARGAQGSCKGTTLPASHRMRG, (SEQIDNO:8166); XM_003432297.3, LRRC17, Del, G_7, GARGPPARPTRTSTRSTWTVRKGNWFTCCPTGLRICCTCCWPGTRSAY, (SEQIDNO:8167); XM_014122263.1, SHC2, Del, G_7, GARGPRTPPPPPSGSARAASSTSRRTAGCTPTPGSWGPGSPTSCGTWAASKSSAPCALWILTLAPR, (SEQIDNO:8168); XM_005627878.2, SYBU, Del, G_7, GARIPSTTSEPCSGAAAWSPCIRCAAPPSTSKP, (SEQIDNO:8169); NM_001110801.1, MAPT, Del, G_7, GARISTKTAMWMSPRPRTPLRPRSPRVRRAPQPEAGHPPTPLPEEPLASPVFQLRVPS ASLSISSPTSPQRSRRQSPPGPAQGPRWKGRPRPPSSPSTWR, (SEQIDNO:8170); XM_005616850.2, CACNG8, Ins, G_7, GARLPHAAQRLPQGGGRRRHGHGHRAARRARARPARARRAGPRDPGQGGRRLQH QHAQQENHAGV, (SEQIDNO:8171); XM_005624150.1, CBX4, Del, G_7, GARPPSTPLTCPPPPPSLSPRSSCWTRIWTSP, (SEQIDNO:8172); XM_005637620.2, WNT8B, Del, G_7, GARRTNPGENP, (SEQIDNO:8174); XM_005618689.2, GAK, Del, G_7, GARSASSQTSRTPPPRSSSLLPITQKEIWTSLTSHLELL, (SEQIDNO:8175); XM_003639660.3, B4GALNT4, Del, G_7, GARTGSSWTGSCRQGWRWNGSD, (SEQIDNO:8177); XM_014109869.1, COL18A1, Del, G_7, GASCGRAATASSPG, (SEQIDNO:8178); XM_005625164.1, PPP1R26, Del, G_7, GASGARETTGQRARTPRKACPSQVFPRCCPHSYSTLERVSPGGAGRPVSSAHP, (SEQIDNO:8179); XM_005616415.2, LOC102151906, Del, G_7, GASGEWFVETPPRMLSF, (SEQIDNO:8180); XM_014121228.1, BSCL2, Del, G_7, GASGPDTASPCR, (SEQIDNO:8181); XM_014116698.1, RNF43, Del, G_7, GASQSPHQPLSPRT, (SEQIDNO:8184); XM_014117924.1, LOC481671, Del, G_7, GASSAMQGLVDLPQQDIPPHHHHYQTPLRRREWKQESRSRMMTWALVFF, (SEQIDNO:8185); XM_005627795.1, DLL1, Del, G_7, GASSATRT, (SEQIDNO:8186); XM_014118331.1, VWA7, Del, G_7, GASTRTAHPRASLPTTCFTSRLQNWPFWPPSKPSAS, (SEQIDNO:8187); XM_538101.4, TNMD, Del, G_7, GASTSGRRHPKKHMTWSTLSTAMERRRRFTWKLIL, (SEQIDNO:8188); XM_014107619.1, ECEL1, Del, G_7, GASTTAPAICCTGGRRLPTAASCARRSASSTCTTISLSTTSG, (SEQIDNO:8189); XM_005639643.2, CCDC80, Del, G_7, GATAALPRPRPGRPKSTRSSRSSRSSRSPRRRRGRS, (SEQIDNO:8190); XM_014120910.1, RTN4RL2, Del, G_7, GATAARTSAASRRARARPARRPRTPAAPRSRPGCPALCSASCSWRPTTS, (SEQIDNO:8191); XM_014120777.1, LOC102153599, Ins, G_7, GATADRWAAGPTRGAPGAHIAASDASPQTQNSRITSELEEQPT, (SEQIDNO:8192); XM_005620829.2, KCTD19, Del, G_7, GATLRVLPRRNAPQSTSHRNLKPKTLLSPLCKNSSPW, (SEQIDNO:8193); XM_005616783.2, TSHZ3, Del, G_7, GATPASTPPTSCPT, (SEQIDNO:8194); XM_533945.4, SAFB2, Del, G_7, GATPPTKG, (SEQIDNO:8195); XM_533428.5, HECA, Del, G_7, GATSTHRCSSCGAWTCPSCSLTSPGIS, (SEQIDNO:8197); XM_005639316.1, METTL14, Del, G_7, GAVEEHTEVAFHLD, (SEQIDNO:8198); XM_005619370.2, C9, Del, G_7, GAVISGAARADA, (SEQIDNO:8199); XM_014120655.1, FAM98C, Del, G_7, GAVQMSWRLPCPPGRAEERMVVGGRQAARAGVARRRRS, (SEQIDNO:8200); XM_014120866.1, MYBPC3, Del, G_7, GAVTSAPVTSMAWQPRAQGTL, (SEQIDNO:8201); XM_014121842.1, LOC106560109, Del, G_7, GAWPRGEERAGARGGRKCASRARGGAPPRPEAEVAPRRRPRFCWRAGVRRAGGG ASPGGGAGFPGNGAPAPC, (SEQIDNO:8202); XM_005632563.2, USP19, Del, G_7, GAWRPQLHEVQWVVQRLPCRQVQPLWIQHHQEAPLTPSQDRRKLGLWRRKNPSLG LRTRGWMVWLPVRPWSM, (SEQIDNO:8203); XM_014121980.1, USP19, Del, G_7, GAWRPQLHEWVVQRLPCRQVQPLWIQHHQEAPLTPSQDRRKLGLWRRKNPSLGLR TRGWMVWLPVRPWSM, (SEQIDNO:8204); XM_855303.4, ARHGEF15, Ins, G_7, GCALHLTSPLHPPLPAALQ, (SEQIDNO:8205); XM_014112681.1, DGKQ, Del, G_7, GCAPASASPRAPTSGSPFSRPRPCRWTASPGCRPPGT, (SEQIDNO:8206); XM_005620429.2, MMEL1, Del, G_7, GCCCCCSW, (SEQIDNO:8207); XM_005636016.2, NOS1, Ins, G_7, GCCGAERPHPGRRHHPRSQRPALGGPEL, (SEQIDNO:8208); XM_003433995.4, ADAMTS1, Del, G_7, GCCLTRAVIL, (SEQIDNO:8209); XM_844169.5, ARHGEF25, Del, G_7, GCCPPEVERDVSSSSSKLSSSVRPWEEEYGVEHRPDMCTRTASR, (SEQIDNO:8210); XM_549068.5, Z:MYM3, Del, G_7, GCFIKPPPPQRWTTVLRGPLHGMQETRP, (SEQIDNO:8211); XM_014122123.1, CELSR3, Del, G_7, GCFLPSSRLSAEVPGSLRT1, (SEQIDNO:8212); XM_014115697.1, LOC102152805, Del, G_7, GCGGIRPPPRKRGWMITGT-SPSLTLLGKPPGLWSRWGAETATPR-PAQSRRPSVGFGPT CSQSSDTTMAPRRTRRRWG-GRRRRPAGGWRVPWGG, (SEQIDNO:8213); XM_843907.4, GPR37L1, Ins, G_7, GCGPALRQARG, (SEQIDNO:8214); XM_535634.4, COQ2, Del, G_7, GCGSWRGRGCGGSAPWPRRARLARSALGTRGLRS-GRNRAGVGSAYRPLRW, (SEQIDNO:8215); XM_014116542.1, WNK4, Del, G_7, GCHPAPL-SPISACPRLLPSPSHVLALAATFPRE-TAMPQMQHQALVMWEKGWHA, (SEQIDNO:8216); XM_542175.4, GIPC3, Ins, G_7, GCHRGGSAQRI, (SEQIDNO:8217); XM_536148.4, ALDH9A1, Ins, G_7, GCHRPAPVSAP, (SEQIDNO:8218); XM_543480.5, PES1, Ins, G_7, GCILGQVSVHWGYC (SEQIDNO:8219); XM_014108967.1, PDZD7, Ins, G_7, GCLPQWGPAGWL-RACGSGWREPGAAITEAPSFPDKLDVKDKVLLD-SLCHLLTAPHL PGQGDVGRKPRSGAWDWWTLSHVPYSAPKH, (SEQIDNO:8221); XM_543229.5, TRIM35, Del, G_7, GCPAGGWAWCGCARTPVPRA TRTAATTTPAQASGT-CAARRGWRGTTA, (SEQIDNO:8222); XM_544457.2, RAB42, Ins, G_7, GCPAHPQDPSPQGPPK-TAAPRSLPVL, (SEQIDNO:8223); XM_545627.5, CPS1, Del, G_7, GCPLVRQENLITQDHKL, (SEQIDNO:8225); XM_548997.5, PPP1R3F, Del, G_7, GCPPAIPWAYSRTET, (SEQIDNO:8226); XM_005618879.1, PRF1, Ins, G_7, GCPPAPAPGTDRLARPGLGLPA-PRGQGQGQLHRGCGQGSSQQHPQRLARGAGCVSQ AQHQCACEHGRLALQGGRLRCPEDPPGQVQLQH, (SEQIDNO:8227); NM_001012395.1, UTRN, Ins, G_7, GCPSLTAPV, (SEQIDNO:8229); XM_546604.4, ALOX12B, Del, G_7, GCQPGACPWVCKALLR, (SEQIDNO:8230); XM_005641483.2, NHSL2, Ins, G_7, GCQQVPGAVTVCAHGLWHHGCL, (SEQIDNO:8231); XM_533246.4, NUDT22, Del, G_7, GCQRSRCGLS, (SEQIDNO:8232); NM_001003264.1, SRP72, Del, G_7, GCRCLRSGVK, (SEQIDNO:8233); XM_005625810.2, FAM109B, Ins, G-7, GCRD-SADPQWRWPKVLVCPQRQPAVLL, (SEQIDNO:8234); XM_005638928.1, ABCG1, Ins, G_7, GCRGEPFSLAPAL, (SEQIDNO:8235); XM_014107476.1, HAND2, Del, G_7, GCRRAPGPRA, (SEQIDNO:8236); XM_005626608.1, SIL1, Del, G_7, GCRSSGAWYR-PRAQRCWPCVWSLCFMTWSLKRCLPRRRLN, (SEQIDNO:8237); XM_014106882.1, COL20A1, Ins, G_7, GCRVGVQHG, (SEQIDNO:8238); XM_014116992.1, PRRC2B, Del, G_7, GCSGRGASTAAARGAAV-AGGCGTLGSPKTSLGPSRGGGSPARRTVRAP-STKSFQSG GGSEARRTGAKARFWSARAAP, (SEQIDNO:8239); XM_005626236.1, LOC102152123, Ins, G_7, GCSPAPPSPDRDRGRGHTAGSRPSVVG-GRAAPGPRVPAPPRAARRFAGLQTGPEL, (SEQIDNO:8240); XM_005632803.2, CC2D1A, Del, G_7, GCSRRI-GYWAQPS, (SEQIDNO:8241); XM_005617274.2, PURA, Del, G_7, GCSTRRRSWPPSGWTSRTSASTWT, (SEQIDNO:8242); XM_849768.4, FAM83E, Del, G_7, GCSWLPTPTVWSAAALWPPCPRRHPTARWPNAWL-PAEYLRVTGRRPRPPQGRR, (SEQIDNO:8243); XM_014118366.1, PHF1, Ins, G_7, GCTEEG-PLCPGHAGHEAVTAIWTKGARLGRWTSEQPTAEL-LLLWWPWGVEPENVA VPELPAVVP, (SEQIDNO:8244); XM_014109906.1, ANK2, Ins, G_7, GCTNLKITMQHNRWNHPSTMGRHYRNYAFNICQ, (SEQIDNO:8245); NM_001289435.1, SLC4A3, Del, G_7, GCVGSSGCPGSRLPPSARSRT, (SEQIDNO:8246); XM_847615.4, SLC16A8, Del, G_7, GCWPR-RAWSWHPSPRASWSCT (SEQIDNO:8247); XM_005637591.2, UBTD1, Ins, G_7, GCWQGRGGREG, (SEQIDNO:8248); XM_544061.5, ZRANB1, Del, G_7, GCWWPCRRVPGGGTTPWSRRW, (SEQIDNO:8249); XM_014114474.1, LOC106558921, Del, G_7, GDAEL-QTLPGTQGAACQQGSRTPASSRSWGPSGI, (SEQIDNO:8250); XM_005632217.2, SRGAP3, Ins, G_7, GDGPDIEKTM, (SEQIDNO:8251); XM_003432747.3, SRGAP3, Ins, G_7, GDGPSAVTIRWSGHPQAPKR-GRHPQPTPGPGSQHRHATPGRRLPQQPPQNPSHPGED REP, (SEQIDNO:8252); XM_005616301.1, TSKS, Ins, G_7, GDHPGQGDHEEKEGRVVPRGGASDVP, (SEQIDNO:8253); XM_005616302.1, TSKS, Ins, G_7, GDHPGQGDHEEKEGRVVPRVGLSHPVGDGP-SAQHCLQQSTSPTGGASDVP, (SEQIDNO:8254); XM_005626758.2, FAM214B, Ins, G_7, GDIPR-GLPGIHLFPSSWCL, (SEQIDNO:8255); XM_849131.4, NHLRC4, Del, G_7, GDPGACTAPRTACSS, (SEQIDNO:8256); XM_003639777.3, SYDE1, Del, G_7, GDQTSCGWTTPST, (SEQIDNO:8257); XM_014122053.1, FLNB, Del, G_7, GDTTFQRAPLRFKLALKQACRKFVH-GALAFMVGLSGGQQTSW, (SEQIDNO:8259); XM_548847.4, STS, Del, G_7, GDTTQARSPP-PLLHCTCPRGTCA, (SEQIDNO:8260); XM_014111463.1, LOC106558415, Del, G_7, GEAHSPSGHLALAT, (SEQIDNO:8261); XM_539681.5, SLC39A2, Del, G_7, GEAWPRLC, (SEQIDNO:8262); XM_014116204.1, TMC6, Del, G_7, GEGAAP-WARGGWLPGGTGARPGPALRPPLPPERRAGP, (SEQIDNO:8263); XM_014122470.1, LOC102156231, Del, G_7, GEGGGGGGPPSW AARGRERASPSQRALAAAP-PRAPPCGPRPSAPGAQSAAAARPGPALRREAAD-SASAP RRALGPHPGARRSGGAGWSASGCGG-GRAAAA, (SEQIDNO:8265); XM_014110905.1, LOC106558304, Del, G_7, GEGTRGTAGGPAR, (SEQIDNO:8266); XM_844406.4, NLGN2, Del, G_7, GEGVPVAAPRAAQAWASAASGRNAFRW, (SEQIDNO:8267); XM_014122111.1, RBM6, Del, G_7, GEIFHLLIS-RAEIHHSWTSGVGTYIL-GIFGIEKDHQWTTGVEMVLLWIIEVERHLT, (SEQIDNO:8268); XM_014108564.1, HDAC7, Del, G_7, GELGTLCCFPWPRAVTGPCPGLSR-PRLRLPPCRLQSPPVRPVSCPAQKHLPGCCRSPQ GWSTTR, (SEQIDNO:8269); XM_547829.5, TMEM260, Del, G_7, GELPGWGRGAP-GACAAAWPCSPPWPPCSPSRCPPRCRGETRGN, (SEQIDNO:8270); XM_014112781.1, ANTXR1, Del, G_7, GELPWAVPRAAWISAPAVWSSAVMLLLT, (SEQIDNO:8271); XM_538049.4, SMC1A, Ins, G_7, GENSGGSGLA-LCHPQLQASPLLRPG, (SEQIDNO:8272); XM_014111168.1, SPEN, Del, G_7, GEPEEPP-PLPTPPPQAAAAAASASAPASRR, (SEQIDNO:8273); XM_005622132.2, ERICH3, Del, G_7, GEQGSGRPPG-GRRSPRPLRGDSGRREGPAL-GAQHLRPEQQRIPGRLQWS, (SEQIDNO:8274); XM_536894.5, EIF3B, Del, G_7, GERNSNKSRD-SATKGFSSLTSHLVKDTW, (SEQIDNO:8275); XM_005628025.2, RHPN1, Del, G_7, GFCGARRSVGVGRQLLHEPAPGPSLAGAARPRGA-RAEGGCPHSP, (SEQIDNO:8277); XM_014112916.1, ZNF503, Ins, G_7, GFGREVRIPGTERHLPAI-HAQDRQPQLQRVGLLARRHAAFGR-GRPGGQGRQEGPRR GRRRRRQQGLRGRLGRRGTR-GAGARPDQLRRRD, (SEQIDNO:8278); XM_544410.5, SALL1, Ins, G_7, GFGSDIQSRRENHQRRFFGDPLPF, (SEQIDNO:8279); XM_547113.5, ABCC6, Del, G_7, GFGSTGSPSHTWGCTRCAPESPSSPRTPRCSPALCG, (SEQIDNO:8280); XM_846580.3, LCAT, Ins, G_7, GFHQAHAGLGLR, (SEQIDNO:8281); XM_533169.4, MPEG1, Del, G_7, GFLSIRASPSRPGSRASPTTWWP, (SEQIDNO:8283); XM_014114562.1, LOC479817, Del, G_7, GFLSPRFSCM, (SEQIDNO:8284); NM_001253744.1, KRT15, Ins, G_7, GFPLGWGRRLWWGESLRGWWKPQYFSFFC, (SEQIDNO:8285); XM_005642089.2, CACNAIF, Ins, G_7, GFQFQTVQCTPGWIPWPQEKLWGFHFHH-PRRRKFSAQGNQRARESGGGRGNSHQR LWPQQALLPR, (SEQIDNO:8286); XM_005621273.2, FBRS, Ins, G_7, GFQWGHWGARGQL, (SEQIDNO: 8287); NM_001284496.2, TAP1, Ins, G_7, GFRGRGPPAS-RLPGLRDAPPPAPAGPVGSLQSWGNGHSILHWPPH, (SEQIDNO:8288); XM_014112916.1, ZNF503, Del, G_7, GFRPRSPDSGYRAPPASHSRPGQAAPAPARRPARQE-ACCLRPGAARRARTTRRTPTW AAAAAPARAP-GAPRPKGDPRGWRTAGSAAAEGLMWT, (SEQIDNO: 8289); XM_014112350.1, UCHL1, Del, G_7, GFVPVWRRRPRSPSLGVAPAPPAQAPEVRQAGAL, (SEQIDNO:8290); XM_538306.5, KLHDC7B, Del, G_7, GFWSPQQHLHSRHLAR, (SEQIDNO:8291); XM_005622611.1, CNST, Ins, G_7, GGAALQRRGPA-GAARPALGRLRG, (SEQIDNO:8293); XM_014111486.1, PTCHD2, Del, G_7, GGADAAPRPPPRPRPIRAGPAE-GPRAGTTRART, (SEQIDNO:8294); XM_14121983.1, ADGRL1, Del, G_7, GGAGPPTFLTS-ALPWSLLPSRGWLQSSCAQGPCRRCWSPLPHTSRNT-SLAHGARTRC RQATVSTS CPGSRTARTR, (SEQIDNO: 8295); XM_014109693.1, LOC106558086, Del, G_7, GGAGRRGAARGPGGRGCPLPRRPHPRRGLGWDLL-GIPRLPA, (SEQIDNO:8296); XM_848801.3, THAP10, Ins, G_7, GGAPGGPRGPARPAPEPSPLRAARG-PEEGRARTDYM, (SEQIDNO:8297); XM_014111368.1, F8A1, Ins, G_7, GGARRGRGRGTRAR-RARRRRRRRRRGPGARGRGLPGPLPAGVEQAA, (SEQIDNO:8298); XM_005624150.1, CBX4, Del, G_7, GGCRGPCQACSSPPSTPHMHSYRALAPE-DRVGPYVIPHLEAAELARFFYAVSPPFPLQ DITRGN-PRRTSWIPGC, (SEQIDNO:8299); XM_543127.5, FREM2, Ins, G_7, GGEH-CAQAQFCGHDDGGGGSVCPDRPDPRHAGGGGCR-VAP, (SEQIDNO:8300); XM_014111418.1, LOC106558412, Del, G_7, GGEPSSPRRPAGPAL-RAWAWVGPGVSRAQGALAYSLLRANL-GRGPAGECGP, (SEQIDNO:8301); XM_005635420.2, UFM1, Del, G_7, GGGGAAPGEQAASAGVSVRGAPR-CRRFPLRSR, (SEQIDNO:8304); XM_005628669.2, LOC102151330, Del, G_7, GGGGEPDLSFLFAA, (SEQIDNO:8306); XM_014116598.1, SIX5, Ins, G_7, GGGGGGGDRRRGGGSAPAPADFAGGRG, (SEQIDNO: 8307); XM_014106692.1, NPHP3, Ins, G_7, GGGGGGGGGGGGRAGVADPRGGRRRAARG, (SEQIDNO:8309); XM_858973.3, DDHD1, Ins, G_7, GGGGGGRRRRRGPRLRLLPARCGARARDGGAGEH-RAGVCAGRPLRGGCDPRRVLP GVLEPS, (SEQIDNO: 8310); XM_014112065.1, LOC491446, Ins, G_7, GGGHCPGLGGLSRGGSLPRGSPARLSFPPGRAHL-HLLWGTRLRPMACDPRVPRLHV ALGV, (SEQIDNO: 8312); XM_005634257.2, CSRNP1, Ins, G_7, GGGPRQPQLFPPR, (SEQIDNO:8313); XM_014107591.1, AADAT, Del, G_7, GGGRGGRP, (SEQIDNO:8314); XM_005623276.2, NFATC4, Ins, G_7, GGGRPCSRMPQHPHHLHLSHA, (SEQIDNO:8315); XM_014109054.1, SORCS3, Ins, G_7, GGGRRA-PAAQHLVRADRGLGPQSGHGALVGTQQQRY-TYPDEAV, (SEQIDNO:8316); XM_014118260.1, KHDC1L, Ins, G_7, GGHGKEGLQQEAMVDCI, (SEQIDNO:8317); XM_547541.5, UBQLN4, Ins, G_7, GGHRRIGDQPGAPDSLEPLWDQCG, (SEQIDNO:8318); XM_014117140.1, IKZF4, Ins, G_7, GGIPPSGPPAPAT-SHHCGGPAQPCLRQRGPQAAGGVTAGHPR-PLQGSAPGGGREW, (SEQIDNO:8319); XM_014114294.1, TECPR1, Del, G_7, GGKSQTSP-WAACPYGLCLCRARCGTERTSATPTPKAH-RGPSWTPQGRRCRSAVGPT TSCGSRSGR-GRPWSGKESTGTIPKEVPGP, (SEQIDNO:8320); XM_014107522.1, BMP1, Ins, G_7, GGLRVGHCGRRRLRR-GAGVPDLRGGGGDRLWLRLHGALRWL, (SEQIDNO: 8321); XM_543274.5, IRS1, Ins, G_7, GGPGGQRWRQQRGGYETPQFGF1, (SEQIDNO:8322); XM_532352.5, SHARPIN, Del, G_7, GGPGPLD-HASAAEPPGRVGPGPSGTGRLA-LRPSGVGRNPKRAAPVSGRPRRSEPRAH GSAAG-PEMGWRRPRARARPPCCWRCRPR, (SEQIDNO:8323); XM_005616718.2, LSR, Ins, G_7, GGPPAGLSGLGR-GRLRVPLSQHLVRSPCQCHPGDCIRSLPRGDPIPAGD-PALHLPIDH NPYGTHRDLEVQVFLPRPYRRCCLLP-SQC, (SEQIDNO:8324); XM_847517.4, C25H2orf57, Del, G_7, GGPSTPAFAWPTRRTAICAP, (SEQIDNO:8326); XM_005623080.2, MTC1L, Del, G_7, GGQGARLVQSLSLTPPGTSPRVSP, (SEQIDNO:8327); XM_005621134.2, ZNF316, Del, G_7, GGQGTWIRLRWSWRRTRTWRTRWQRSRV, (SEQIDNO:8328); XM_862898.3, LOC611145, Ins, G_7, GGRAAPAGPRPWSKEALSSPLLRPGPPPPGALPRLAT-PASAALSESGSPRAPPAPSRTL PQGPETPVPGM, (SEQIDNO:8330); XM_862887.2, PRR23A, Ins, G_7, GGRAAPAPAGPRPWSKEALSSPLLRPGPPPPGALPR-LATPASAALSESGSPRAPPAPS RTLPQGPETPVPGM, (SEQIDNO:8331); XM_540538.1, RAG1, Del, G_7, GGRASPCCR, (SEQIDNO:8332); XM_014116569.1, GLTSCR1, Ins, G_7, GGRLPFRDLGAGVLLPVLLL-VLLRRLLPGRR, (SEQIDNO:8333); XM_005630813.2, SNX27, Ins, G_7, GGRPGRGAQGGPHPGGERREC, (SEQIDNO:8334); XM_854895.4, SH3BP5L, Del, G_7, GGR-PRRGSFGLRL, (SEQIDNO:8335); XM_014122606.1, ST5, Ins, G_7, GGRPTPGEGRQWLH, (SEQIDNO:8336); XM_005629015.1, LOC102155600, Del, G_7, GGRTP-PADALRSWGEGPC, (SEQIDNO:8337); XM_014120941.1, DRAP1, Ins, G-7, GGRTVVFGVRTPR-PLPCPPGVRVPSPLSRENLSR, (SEQIDNO:8338); XM_014117368.1, TRIOBP, Del, G_7, GGRVRRSLQER-RALTDLWRVRVAAGGRALA, (SEQIDNO:8339); XM_005637247.2, IFFO1, Del, G_7, GGSGSARLPSRRTPPCRKVMGPASPMGMRRRAQP-SASTRRCSACSTS, (SEQIDNO:8341); XM_005632813.2, NACCI, Ins, G_7, GGSGSSGGGSRGCGE-WAQHVRADQPGHLERLYQRQPWLLPQ, (SEQIDNO: 8342); XM_544572.6, MASP2, Del, G_7, GGSRRTC-FALA, (SEQIDNO:8343); XM_014107265.1, HELZ2, Ins, G_7, GHAAGAAQCHPAAWLPGTESAA VHGGTRLHPLPGARGAAGQLLPGPDAPGRAR-PLSRRGRVLPRVGALLLGVGHRRR LGE, (SEQIDNO: 8345); XM_847967.4, UBC, Ins, G_7, GHADLREDLDG, (SEQIDNO:8346); XM_005616765.2, PEPD, Ins, G_7, GHAPQLLHLHLWQW, (SEQIDNO:8347); XM_005616462.2, PVRL2, Del, G_7, GHCWCCCFLLGGPWPSSC, (SEQIDNO:8348); XM_005618689.2, GAK, Ins, G_7, GHGAPLHKPQGHLLQGHPVCCQLRKRRFGHLLHHI, (SEQIDNO:8349); XM_014110368.1, LPP, Ins, G_7, GHGLCLYATARTSA, (SEQIDNO:8350); XM_005627878.2, SYBU, Ins, G_7, GHGSRLQHRSPAPGLLRGRPAFAAPHRLPHQNL, (SEQIDNO:8351); XM_538279.5, BEST3, Del, G_7, GHHLRGSRKGPEPGSSP, (SEQIDNO:8352); XM_537234.5, PYCR2, Ins, G_7, GHHPCPALPREWGLPLPAHQCCGGLLHPHTRAAVHG, (SEQIDNO:8353); XM_005632658.2, HAPLN4, Ins, G_7, GHHRLALPLPL, (SEQIDNO:8354); XM_014121228.1, BSCL2, Ins, G_7, GHLAPTPLLLAGKHPKKRQFPEASTAKDLSPSSRAPRPGGVNTAVRHHRGR, (SEQIDNO:8355); XM_005631612.2, BSCL2, Ins, G_7, GHLAPTPLLLAGKHPKKRQFPEASTAKDLSPSSRHRAPRPGGVNTAVRHHRGR, (SEQIDNO:8356); XM_005637953.2, SULF1, Ins, G_7, GHLHQRFCDYPHVLPLPVLHAHRKICAQPQCLHQQ, (SEQIDNO:8357); XM_014119783.1, SSPO, Ins, G_7, GHPLHPGPCRGQPWGPLLCHTAVPAAGRLS, (SEQIDNO:8359); XM_005630240.1, AGBL5, Del, G_7, GHQLPSAALPLPLTMSSTCGPDQTVLKQNLRMGTGLGSTSVSGEELQGNSSRSTL, (SEQIDNO:8360); XM_014118331.1, VWA7, Ins, G_7, GHQQGQHIPGLLSPPHASPPGCKTGPSGLHPSLQPPEKPPGRQGFL, (SEQIDNO:8361); XM_540475.4, NPTX1, Ins, G_7, GHQVDIRSLSPDQL, (SEQIDNO:8362); XM_543740.5, YARS2, Ins, G_7, GHRAPRRPQRPPQGARGAGAGAGAGERARPPPRPRGRGG, (SEQIDNO:8363); XM_014116695.1, BZRAP1, Del, G_7, GHRARETRCGVSSPRESNS, (SEQIDNO:8364); XM_014119669.1, ADPRHL2, Ins, G_7, GHRHHSHHGRGHCWCLLWDGAGARELAAKL, (SEQIDNO:8365); XM_014112419.1, POLG, Ins, G_7, GHRIRNVQ, (SEQIDNO:8366); XM_005632929.2, ARHGEF18, Del, G_7, GHSQHPARWERGHSLDQSQEKWMKPTLCF, (SEQIDNO:8368); XM_005629920.2, HTRA4, Ins, G_7, GHVRLPGDGGGGVRQRRAHLPQPVRAARPEPRGASPGRAPGRAGAEGRLRGARGLECRPAPEPVQLPRGGGGEGGALRGAPAAVPQVTS, (SEQIDNO:8369); XM_005622757.2, EFNA3, Del, G_7, GHWETGMRCTGTAPTSTCDERATRCR, (SEQIDNO:8370); XM_014113772.1, GLIS1, Ins, G_7, GHWPASMPVGGLLRGL, (SEQIDNO:8371); XM_005623080.2, MTC1L, Ins, G_7, GHWRHKRGSLRTRAQQVALRPLQAPPRLCGGRAAPPRKCPLRPPGFCLLAARPADV QEHE, (SEQIDNO:8372); XM_541491.5, SCAFI, Del, G_7, GIGTETGTEIGTGTGHPRRLGLPRSQRPPRGPRQSHRSAAAQALRRPHAPLPPGR, (SEQIDNO:8373); XM_005626080.2, EPAS1, Del, G_7, GIHQAAALHIRYGKG, (SEQIDNO:8374); XM_005616334.2, BCAT2, Del, G_7, GIMGPQYLCSKRRRRGAVNRSSGCTGRTTSSPRWAP, (SEQIDNO:8375); XM_005634338.2, EOMES, Del, G_7, GIMLFTQLP, (SEQIDNO:8376); XM_005630240.1, AGBL5, Ins, G_7, GISSHQQHCLFP, (SEQIDNO:8377); XM_014113963.1, HSF4, Del, G_7, GKARPGWPWPQTSVIFA, (SEQIDNO:8378); NM_001048121.1, HSF4, Del, G_7, GKARPGWPWPQTSVTSA, (SEQIDNO:8379); XM_005620267.1, LDLRAD1, Del, G_7, GKATAPSAACAGEPASLPSCCSCW, (SEQIDNO:8380); XM_846313.4, CENPB, Del, G_7, GKERSWGRKRRWKRRVMLMTVMKRRRKRRKRAPLRGWRPRTGPRG, (SEQIDNO:8381); NM_001048128.1, RING1, Del, G_7, GKESLGRERGMERM, (SEQIDNO:8382); XM_005625506.1, TIMELESS, Del, G_7, GKGLLVRKNS, (SEQIDNO:8383); XM_005637906.2, TUBGCP2, Del, G_7, GKGPRSTSR, (SEQIDNO:8384); XM_005641785.2, PRR32, Ins, G_7, GKGQQWGHRERWQ, (SEQIDNO:8385); XM_014114950.1, LOC100856175, Del, G_7, GKQVTGMVWGVLGELGQGVR, (SEQIDNO:8387); XM_005625037.2, PNPLA7, Ins, G_7, GKRLCPGWHHPGPGRVWHPCGHGRRDNWGLHGCPVLRGAELQPDPDPGQGVG, (SEQIDNO:8388); XM_005629022.2, SLC5A9, Del, G_7, GKRQSAAARPRSGRQARAGGVAGCWGPGSAGSPDTPSQH, (SEQIDNO:8389); XM_005628665.2, JAZF1, Del, G_7, GKRSPSPARFLDVKRDTRM, (SEQIDNO:8390); XM_005637080.2, PDE3A, Del, G_7, GKRSSSSGWASGRIACCRSRPRGWCSAAWPPRHGWC, (SEQIDNO:8391); XM_003435196.3, MRC2, Del, G_7, GKSESPHPAMPVFLPSAGSGSPGIGSSTWAPCSAWAQAGRVPTPQHPW ACTSVTGRH, (SEQIDNO:8392); XM_005637916.2, SPRN, Del, G_7, GLAAAPGEGCAGARGGPRGCA, (SEQIDNO:8393); XM_003433278.3, SPATA25, Del, G_7, GLAGRYYSGLSMADTTTNSPMQGSQRAWAGRMAAPEAELPSWVAPAGLGPCCCV GCHQGFYRCPPRQGGRRPAPSLTSASLPWP, (SEQIDNO:8394); XM_005619964.2, PHF23, Del, G_7, GLALGCLGGLGQLLGTGKRGLELRRARNGS, (SEQIDNO:8395); XM_014114474.1, LOC106558921, Ins, G_7, GLAPFFSLVDGRRTPGQRPEQAAG, (SEQIDNO:8396); XM_005632900.2, RAVER1, Ins, G_7, GLAPGAATPAREATTSAAATAWPLWG, (SEQIDNO:8397); XM_005641605.2, TCEA14, Del, G_7, GLCGCKKVYRTPSTRGAQGN, (SEQIDNO:8399); XM_005633211.2, MAST1, Ins, G_7, GLCHPAEEHRGTACGDGPHVLR, (SEQIDNO:8400); XM_845262.3, ITGA10, Ins, G_7, GLCIVARRGSPPFPPTDSPGR, (SEQIDNO:8401); XM_014117894.1, ABCA1, Ins, G_7, GLCLLARCGGAGDHQGADGHREENWRLCATDALPLLRR, (SEQIDNO:8402); XM_014114637.1, LOC102151838, Ins, G_7, GLECGSYGEGMFVVSSLPIMAG, (SEQIDNO:8403); XM_003432297.3, LRRC17, Ins, G_7, GLGAPLRGLHVPPREVLGLSGKETGLRAARLASGSAAHAAGQEQDPHIEGQDVFQV, (SEQIDNO:8404); XM_534308.5, IGSF10, Del, G_7, GLGDLSLFTPVVPSSFRIPKLQILGSTNAQQGTHLVAIMQQLTFR, (SEQIDNO:8405); XM_014106904.1, MMP15, Ins, G_7, GLGGSPDSECAAGAGAGAGARAAGSQRSADSAGAAGALP, (SEQIDNO:8406); XM_005616888.2, CAPN12, Ins, G_7, GLGGSRSVGPGEGGAHPQVHCPSVTHPAQPAAPEGPGPHLPHRGLPCVPAAGGRTA GIREVAAGPWGGAHRDCLGSEVACPRLPPEQPADPGPH, (SEQIDNO:8407); XM_014107847.1, EP400, Ins, G_7, GLGLWDDVPTTPHQPLQDCGAPGPLQPSSHICGECRGTKGP, (SEQIDNO:8408); XM_014106951.1, RTEL1, Del, G_7, GLGPVSPTRFTSTLMLVTTGRVLGRMPGAARLPESQGRC, (SEQIDNO:8409); XM_014106952.1, RTEL1, Del, G_7, GLGPVSPTRFTSTLMLVTTGRVLGRMPGAARLPESQS, (SEQIDNO:8410); XM_014107981.1, ARAP3, Del, G_7, GLGRAGRPLCRKP, (SEQIDNO:8411); XM_014113859.1, SLC22A31, Ins, G_7, GLGRLFPCPLRGSLGAV, (SEQIDNO:8412); XM_014116991.1, PRRC2B, Del, G_7, GLGRRPLGQVVVTLLPVMRANRMGRL, (SEQIDNO:8413); NM_001346058.1, KRT23, Del, G_7, GLGVSASPFPSAHQGVCLLEGLGDLEKAIPSRVQVGRK, (SEQIDNO:8414); XM_014115372.1, DCST1, Ins, G_7, GLHACPASSENHWSPEQLLGDSGGIKQHALPAPAHGSGCQGLSEGRTPHGPAAVPLP APGLRLPTSEGHRSLLLPQAREEEDPVPLQ, (SE- QIDNO:8415); XM_538573.4, GRM6, Ins, G_7, GLHCPVHQDSQGTKARRIQ, (SEQIDNO:8416); XM_005636883.1, KMT2D, Del, G_7, GLHFLVRAPLRDPVFTQ, (SEQIDNO:8417); XM_005633560.2, ART1, Del, G_7, GLHLHPCRTSQPSSLGRIPSSASGLAL-GHLSRAIPSSPGRRRC, (SEQIDNO:8418); XM_005621226.2, SLC5A2, Ins, G_7, GLHPHGLR, (SEQIDNO:8419); NM_001007142.2, SLC5A2, Ins, G_7, GLHPHGLRLP, (SEQIDNO:8420); XM_005631198.2, CTNND1, Del, G_7, GLHPLTGDSQSCLR, (SEQIDNO:8421); XM_014122787.1, SAAL1, Ins, G_7, GLHREHRLQQALGLRGPQRVHPDC, (SEQIDNO:8422); XM_003639638.3, POGZ, Del, G_7, GLKSHMSGLCVSCSGTT, (SEQIDNO:8423); XM_845299.4, LOC608319, Ins, G_7, GLKSYPREKLSSLGAESLGSSPGTSHLPPNLWGSAAWE-EQEVFLGSIGKQTVQAHRP LPEEIWAQEDTGV-GASGGDRRRQ, (SEQIDNO:8424); XM_535802.5, NDUFS6, Del, G_7, GLLATRKCT, (SEQIDNO:8425); XM_014109663.1, LOC102154979, Ins, G_7, GLLEEL-GAGEEGSRGCGRGGLPERRPGTRSHSPGG-GAAVDWVEWGVPPGEREAGG RRRWPLQ, (SEQIDNO:8426); XM_005636328.2, ACACB, Ins, G_7, GLLGGRGL1HQPLVHRNVCRQGEQGKYSGARGHS-GD, (SEQIDNO:8427); XM_014121693.1, GRIP2, Del, G_7, GLLPGVTC, (SEQIDNO:8428); XM_005625541.1, GLI1, Ins, G_7, GLLQGAEAFQGSVHAGGA-HAQAYGREAAQVYV, (SEQIDNO:8429); XM_005626855.2, CORO2A, Ins, G_7, GLLRHSPASDG-KIGPPLPKGLRAQRERLRHQVESF, (SEQIDNO:8430); XM_005639100.2, FRAS1, Del, G_7, GLMGLKVLM, (SEQIDNO:8431); XM_005625008.2, PTGS1, Del, G_7, GLMVERSRPSGNMEQGEGLSGEIFWKMQE, (SEQIDNO:8432); XM_014121831.1, TLE6, Del, G_7, GLPAAGIRVHGSRLEPWTPLEDPGLCPEPAAP-PAQDLGPVHASRLRDVGLRKAFWV HN, (SEQIDNO:8433); XM_014116184.1, MTA1, Ins, G_7, GLPA-PRQAAEDELDRRPR, (SEQIDNO:8434); XM_005623126.2, LIPG, Ins, G_7, GLPARLWTQ, (SEQIDNO:8435); XM_541696.5, LGI4, Ins, G_7, GLPAVGPARPRPAPGAHPSPGPAAAAAAQ, (SEQIDNO:8436); XM_014116133.1, UNC79, Ins, G_7, GLPHLPEGRKSN, (SEQIDNO:8437); XM_005632383.2, KCTD6, Ins, G_7, GLPHSSRPSRQLLH, (SEQIDNO:8438); XM_005642089.2, CACNA1F, Del, G_7, GLPIPDSPVYPRLDPMATGEALGVSFSPSPKKEVLSTREPK-SKRIRRRKRKFPPKTLAT TGSPT, (SEQIDNO:8440); XM_546641.5, TRPV2, Ins, G_7, GLPLGGPAMVLLEAS-SVHLDLLRGQLL, (SEQIDNO:8441); XM_005627200.2, ZBTB22, Del, G_7, GLPLGSCCWRQMSCAMTAGTRGVLW-FLGLGSSGGPPTHPPASCHRNTGYM, (SEQIDNO:8442); XM_014114199.1, SRRT, Del, G_7, GLPLRN-PLRKGTQQRSMWSEMKN, (SEQIDNO:8443); XM_536148.4, ALDH9A1, Del, G_7, GLPPASS-CVSTLTWPKSPSPEACPPA, (SEQIDNO:8444); XM_546739.5, MEGF6, Ins, G_7, GLPPGPGRL, (SEQIDNO:8445); XM_014119249.1, CSMD2, Ins, G_7, GLPQPAQRKLLRSQQSRPHREQQQQPLLGLPQRRL-REQRSLRHRLHRKPTGVLF, (SEQIDNO:8447); XM_014119707.1, E2F7, Del, G_7, GLPQTRSSSVHARSA, (SEQIDNO:8448); XM_005629174.1, E2F7, Del, G_7, GLPQVSCPP-WAFRAWSCRLPRWARFPCSTLPPCPGRSPLPPAR-SQTRSSSVHARSA, (SEQIDNO:8449); XM_014106366.1, TBC1D4, Ins, G_7, GLPRAQKKAS-RAHPGRFWP, (SEQIDNO:8451); XM_539968.5, ADGRA2, Del, G_7, GLPSAPTPSTSL, (SEQIDNO:8452); XM_014113773.1, GLIS1, Del, G_7, GLPSGPGLAPPPR-RATRAVCSLKPAGRGAS, (SEQIDNO:8453); XM_014108967.1, PDZD7, Del, G_7, GLPSSVGPCR-LASSLWQWMERAWSSYH, (SEQIDNO:8454); XM_014108966.1, PDZD7, Del, G_7, GLPSSVGPCSYH, (SEQIDNO:8455); XM_849485.4, FAM209B, Ins, G_7, GLPVSPPSLHPPWRLLQGDPREPPEPPPEASQWPL, (SEQIDNO:8456); XM_014118740.1, EEF1D, Ins, G_7, GLQAGSGGLWHPQAADPVRGGGRQGGDR-PAGGGDHQVRGARAECGHCCFQQDL, (SEQIDNO:8457); XM_014106882.1, COL20A1, Del, G_7, GLQGG-GAARINTKLPRSRASGWLGTGGFRGLGGDLQARG-QMWGSQEGPWWLLAH QEG, (SEQIDNO:8458); XM_014108010.1, MYO18B, Del, G_7, GLQGLLVAPR-PALRTQPQRPRSPGLRVLGTQAWCY, (SEQIDNO:8459); XM_005622091.2, CASKIN1, Del, G_7, GLQI-MATLWRMVPPGSGLEVQPRVRRVRRAHPWPGWR-PVPRSRGASEPSRASRRTS SSS, (SEQIDNO:8460); XM_005626236.1, LOC102152123, Del, G_7, GLQPRA-PEPRS, (SEQIDNO:8461); XM_014119335.1, MYCL, Del, G_7, GLQREVPKKRLWRETPQRKRKKWMKRL, (SEQIDNO:8462); XM_533945.4, SAFB2, Ins, G_7, GLRLRQKDE, (SEQIDNO:8465); NM_001253741.1, KRT14, Ins, G_7, GLRPGGRLWRRLQQQQQLWWGPG, (SEQIDNO:8466); XM_548101.3, KRT16, Ins, G_7, GLRPGGRLWRWLQQQQQLWWGPG, (SEQIDNO:8467); XM_548143.3, PNMT, Ins, G_7, GLRRAGGR-VAGVPGPPARAPSACRSDTKGDWRGAHRAR-SPGRPQARPPPPQRRG GRGTRGT, (SEQIDNO:8468); XM_014120910.1, RTN4RL2, Ins, G_7, GLRRRGPAR-RADVPGRGLPGAPGLPRPRALGRAAQPSALPPAP-GAPPPL, (SEQIDNO:8469); NM_001287152.1, PIGR, Del, G_7, GLRSSTRAGSHCMKSQAMAPTRSSST-SSPPTMLASTGV, (SEQIDNO:8470); XM_545865.4, CRTC3, Del, G_7, GLRTPPLDWGRSL, (SEQIDNO:8471); XM_541157.5, MTRF1L, Del, G_7, GLSCWRRPNC, (SEQIDNO:8472); XM_533169.4, MPEG1, Ins, G_7, GLSGMHPALGEGGRPAVPNL-GAEEPPHWCFLLPLWLLPHPPAIPGPRGGLQPPGVPA QVHPPRLLQDGVRRRVPGGEG, (SEQIDNO:8473); XM_540709.1, OR14DL1, Del, G_7, GLSMQQYSFSS-CINYPSVASMLLITLCVICFPC, (SEQIDNO:8474); XM_014116336.1, LOC102156711, Ins, G_7, GLSPALL-PAQPPRAPQAPSPGPGTLPPPWGAALSFHHC, (SEQIDNO:8475); XM_538389.4, CARD10, Del, G_7, GLSPMTRAQMACPSLGTAGLGPWCGGCSRGR-GLPGWSRESHGQRLLAWRGQAWK VRSSREPCP-GARCPRSPS, (SEQIDNO:8476); XM_540228.5, EGR4, Ins, G_7, GLSRFLLPGGACTHAPSWPQLQR, (SEQIDNO:8477); XM_547872.5, EXD2, Del, G_7, GLSYGKASSGGGGIKRALTLGSSGFGSSKHPVGD-SCPLQRRTSCAPVPPEPHGRRGSS EQRW, (SEQIDNO:8478); XM_014120548.1, GRHL1, Del, G_7, GLTDSL-SPRS, (SEQIDNO:8479); XM_005624875.2, SEZ6, Del, G_7, GLTRCPWPTSLSY, (SEQIDNO:8480); XM_844392.4, ABCF3, Del, G_7, GLTSTAPFSRNS-SAVRASS, (SEQIDNO:8481); XM_005619376.2, EGFLAM, Ins, G_7, GLTVPLQPGQRWCDLLR-RYCYTVSSVLWPLLCNL, (SEQIDNO:8482); XM_014114800.1, COL11A1, Del, G_7, GLVHLVPKVRVVTQVLRALVVFKVHLVQREN-LEKGVVQVLMEEEECQENLEQREI GDLMDFQVCQVTKVTGANGAPKAPLVLLEKME, (SEQIDNO:8483); XM_014121616.1, IL17RE, Ins, G_7, GLVLPPGAEIQKVT, (SEQIDNO:8484); NM_001253744.1, KRT15, Del, G_7, GLVVVLGVAS-VEGLVVVLAEASEVALEVALVGVMAAALVTTVVAM-VASSLAMRR SPCRTSTTAWPPTWTRCTPWRRP-TATWR, (SEQIDNO:8485); XM_535893.4, RANBP9, Ins, G_7, GLWEQTKRQNS, (SEQIDNO:8486); XM_005628325.2, LRRC66, Del, G_7, GLYVPVRTVI-PEGL, (SEQIDNO:8489); XM_533901.5, GCDH, Del, G_7, GMGFLMSIM, (SEQIDNO:8491); XM_005630824.2, LINGO4, Del, G_7, GMLFFPALETETQPPLSPG, (SEQIDNO:8492); XM_014122055.1, IFRD2, Del, G_7, GMPWMSRAS-RRTLRRS, (SEQIDNO:8493); XM_005631472.2, RE1A, Del, G_7, GMRSSCSVTRCRKRTLKCISRDQAGRPEAP-FLKLMYTDK, (SEQIDNO:8494); XM_014111170.1, PLEKHM2, Del, G_7, GMVTALSAAQAWGGRPRTP-PLRPPRRRERGPAAQPRAASSRSPARWACLSPR, (SEQIDNO:8496); XM_543480.5, PES1, Del, G_7, GMYPGT-SLCALGLHMMSQTPASPTRLSTGLGSRPLFLAGTM-CSLSGCLTV, (SEQIDNO:8498); XM_014117000.1, HMCN2, Del, G_7, GNCRSRRWT, (SEQIDNO:8499); XM_014114843.1, EPHX4, Ins, G_7, GND-CLANRHLLSRNGDEAYCY, (SEQIDNO:8500); XM_014114365.1, SETD1A, Del, G_7, GNPR-PLHPLHPLPSNPEVSLNR, (SEQIDNO:8501); XM_014120131.1, SORBS2, Del, G_7, GNRFRLCIT-ILLGMKMSWSSEKVMSLM, (SEQIDNO:8502); XM_005624372.2, HEXIM1, Del, G_7, GNR-SPRPSLSHSHVLIPRPTSWGLLLRGARRRGDSSRD-SWARKNIGDAPPRRSGIGNR TTS, (SEQIDNO:8504); XM_005624466.2, KCNH4, Del, G_7, GPAASSST-TASPRPCGTASSSLPPSTLRSPSPTMSASWAM-MIPPSLRDTPLSATSPWRC SSSWISS, (SEQIDNO:8505); XM_539219.5, FOXH1, Del, G_7, GPAGPHPFPLSTEPGL-STYCRLPQTPGGCPVGVTGPHSGGSCPPPTCP-STLPMW, (SEQIDNO:8508); XM_014107173.1, PCED1A, Del, G_7, GPAGSGLDTQTD, (SEQIDNO:8509); XM_536708.5, ATAD3A, Ins, G_7, GPAGSQGQMEQL, (SEQIDNO:8510); XM_005631320.1, LOC483656, Ins, G_7, GPALPQL-PHPRALL, (SEQIDNO:8511); XM_014117074.1, LOC491341, Ins, G_7, GPALRGPRRPLPPRALCPRPL-PRAPRRPLRVPLLARLRL, (SEQIDNO:8512); XM_014118328.1, DDAH2, Del, G_7, GPALWWPVAATQPKRLSGRWQC, (SEQIDNO:8513); XM_546222.4, SIMC1, Del, G_7, GPARAGRGGSAGPCRGPPALCPAGPWTSLT, (SEQIDNO:8514); XM_005624044.2, CYTH1, Ins, G_7, GPARGAAPESV, (SEQIDNO:8515); XM_014112406.1, NMBR, Del, G_7, GPARTFCPPRTGPAPSSPSAA, (SEQIDNO:8516); XM_014121804.1, CACNA1A, Del, G_7, GPARTPSPPPNWTQVEA, (SEQIDNO:8517); XM_014106771.1, XIRP1, Del, G_7, GPASGRR-SWCLASFPGSSAKCCAGQMWTSRGCWFRRTQRAS-SALSH, (SEQIDNO:8519); XM_005620375.2, SCNN1D, Del, G_7, GPASLIPHNAPGSPGRSPC, (SEQIDNO:8520); XM_005629656.2, ZNF775, Del, G_7, GPASPASSSAT-SAARASLGGRRSPSTSASTRASGPIRAPSAAAASAR-SPT, (SEQIDNO:8521); XM_531734.5, GTPBP1, Ins, G_7, GPASQSEVPGGLRDSCQRLL, (SEQIDNO:8522); XM_546739.5, MEGF6, Del, G_7, GPASRAW-TAVTAPRAGLGSSAMRLVLQTPSGR-TAASPAAVRTVGPATL, (SEQIDNO:8523); NM_001005760.1, LIFR, Del, G_7, GPATSHRCTSPSLL1, (SEQIDNO:8524); XM_014113162.1, MYO10, Ins, G_7, GPAVSRRPLRLRPGR1, (SEQIDNO:8526); XM_858228.3, EMC10, Del, G_7, GPCCSQPCVLL-PRGPRRRRRRP, (SEQIDNO:8527); XM_847431.4, LOXL3, Ins, G_7, GPCGGELCARPSLRSVQ, (SEQIDNO:8528); XM_005632900.2, RAVER1, Del, G_7, GPCPRSCHPGEGSHHLCCRHCLAP1GVTGKP, (SEQIDNO:8529); XM_014106275.1, PCDH17, Del, G_7, GPCPSSWRRTTTTSTPW, (SEQIDNO:8530); XM_014113162.1, MYO10, Del, G_7, GPCRQQTAT-TTTTGTTMRTAPPPPAAA, (SEQIDNO:8532); XM_014121817.1, LOC106560102, Ins, G-7, GPCTP-GAPARAPAGSGCEPPPRLCARH, (SEQIDNO:8533); XM_014108308.1, LOC106557874, Del, G_7, GPCVAARGKGPCRACALWGL, (SEQIDNO:8534); XM_014121155.1, CD6, Del, G_7, GPDGRLSEN, (SEQIDNO:8535); XM_003431554.4, LOC481426, Ins, G_7, GPDLPAGRQETGPGRLGERPEGHGVCAALGKE-CEPVVARIAHSGLRPRRPPFVRLPG DALSE, (SEQIDNO:8536); XM_844284.4, MLX, Del, G_7, GPEDE-GIPCSPQRSPRPSGPGAAEKTALTPRVPRWNMPTAI-TAWTPGFL, (SEQIDNO:8537); XM_003431813.2, GLI4, Ins, G_7, GPEDPSEEPAP, (SEQIDNO:8538); XM_014114499.1, FAM57B, Del, G_7, GPELRAAPGP-WRAAICTRSSSWCSTTPSWCSYASRCLWCGVKARE-ISF, (SEQIDNO:8540); XM_850179.4, ALDH4A1, Del, G_7, GPEPLEPMTSQAGPTTSCGGRRPRSSRRPTSL-WAIGATPTCS, (SEQIDNO:8541); XM_005622264.1, LOC100855804, Ins, G_7, GPEQGKTERSHKDSVGQW-DRPGGSWGQQWARWSWGPGVSRRESF, (SEQIDNO:8542); XM_845505.2, TLX1, Ins, G_7, GPERCGGDP-GARA, (SEQIDNO:8543); XM_548256.5, MMP28, Ins, G_7, GPGARLPAPPGRSALRRRRALVPEPPPRPQPVR-GAGARDRPHARAGALPRAARAHG ALLQEAGPR-RAAQLGRRAGRAGPVWKAPGGLSSHPAPRKAVH, (SEQIDNO:8544); XM_014114446.1, MSLN1, Del, G_7, GPGCGSAPLTCCSSGSWCVTWTRPASRLQTPVCWRT-CSAAAGSLPPSKPPSTRC, (SEQIDNO:8545); XM_014117147.1, ZC3H10, Del, G_7, GPGCLTGTAMP-TALGAAVEALEAVAMRRPVGQGQAVAGPAQJMPS-VETS, (SEQIDNO:8546); XM_005631695.2, TMEM132A, Ins, G_7, GPGGGDRAHWL, (SEQIDNO:8547); XM_539936.4, MNX1, Del, G_7, GPGISPHPS, (SEQIDNO:8550); XM_531653.5, XRCC6BP1, Del, G_7, GPGKGSSPASSPTTRGASGCS, (SEQIDNO:8551); XM_014120762.1, NAMPT, Del, G_7, GPGPGA-TRAARGQPPPPEPQRPRARPGARARRLLTINSTH-PIQVKFIPTLNAVKRRQKT PK, (SEQIDNO:8552); XM_014119666.1, EML2, Ins, G_7, GPGPGWGWG-GRRWLWRGDGGARPGLLRPLRHVLAASILQR, (SEQIDNO:8553); XM_539881.5, TMEM178B, Ins, G_7, GPGPHANLGILLYLGPFCPTCPEDQLP, (SEQIDNO:8554); XM_005626996.1, KLF4, Ins, G_7, GPGR-GAGRRRWRRRRRRRPPLQPGARAPSHG-PLQPGGHQRREPLGRLRG, (SEQIDNO:8556); XM_014121926.1, SLC25A23, Ins, G_7, GPGRR-GAAAALGSPLRGAGQ, (SEQIDNO:8557); XM_014109896.1, LOC106558120, Del, G_7, GPGRWP-SASSKGCAAQILAPPPPRMAADCRPRSDGEKER-AAIPMDAVPGRGKRKRL QV, (SEQIDNO:8558); XM_014119531.1, CCDC61, Ins, G_7, GPGSRPSCPPLA-LAHR, (SEQIDNO:8559); XM_005635974.2, PASK, Ins, G_7, GPGSRRGHPGRLGSWRLPPPFP-PASANSDSGSGKHPKRKLISP, (SEQIDNO:8560); XM_005628670.2, TRIL, Del, G_7, GPGTGPPGSS-WATAAL, (SEQIDNO:8561); NM_001003016.2, MCLI, Del, G_7, GPGWGPAAAAPPLREGGFWLRGRR-PRPDGREGEGKPVR, (SEQIDNO:8564); XM_857445.4, SLC6A9, Ins, G-7, GPHHHGFLQQVPQQLLPGQHYHQHH, (SEQIDNO:

8565); XM_003434804.3, PRRT2, Ins, G_7, GPHHHRLLRHQLRRV, (SEQIDNO:8566); XM_014116730.1, ARHGAP33, Del, G_7, GPHPHPPRTQHAS-WPWPWLSGLSRWPRDRANRSMGAPLLLPTPLS-TAHCHWRWAV SPQGPQGLGQPPIP, (SEQIDNO:8567); XM_540643.3, LOC483524, Ins, G_7, GPHQRIHDD-CYCWN, (SEQIDNO:8568); XM_005616765.2, PEPD, Ins, G_7, GPHRGGRRGDRQWHGTADLCAPHGGGD, (SEQIDNO:8569); XM_005619266.1, LARP1, Ins, G_7, GPHRQPHLTCQDECRAGQGH, (SEQIDNO:8570); XM_847576.4, ZNF428, Ins, G_7, GPISSGPPCSPT-PRPPSPALPALWPLTPWGGPTRHPTL-PALLPCYSPPGSSSP, (SEQIDNO:8571); XM_005617918.2, KIAA1522, Ins, G_7, GPITQL-PRLSSG, (SEQIDNO:8572); XM_005630511.2, SEMA4F, Ins, G_7, GPLCCHCEKLPGDGADYLPGCGSHRGLDS-DRDLAVLA, (SEQIDNO:8573); XM_005616796.2, C1H19orf12, Del, G_7, GPLGACWARG, (SEQIDNO:8574); XM_005631690.2, CD5, Ins, G_7, GPLG-GLRVPGETERLQLTVPGPAG-GLHREKLVHSVQPELELEPEPKPLGGT, (SEQIDNO:8575); XM_005627795.1, DLL1, Ins, G_7, GPLLQPGPELLHPPQALQEWGHLYQHRAGKLHLLL-PARVLGGQL, (SEQIDNO:8578); XM_014119273.1, LOC106559736, Ins, G_7, GPLPRPAAGPPAPRQDS-GRSSQSPLPRPSPEGGGAGGDPGGLPQPQRNRKTWE-EQNL EPRRRDCPGRRGPGRAGDAA, (SEQIDNO:8579); XM_546739.5, MEGF6, Ins, G_7, GPLQPGYGAVPVPSRENWG, (SEQIDNO:8580); XM_005636656.1, LOC102153039, Del, G_7, GPLQVASQLWARQPGFWG, (SEQIDNO:8581); XM_014116698.1, RNF43, Ins, G_7, GPLRAPTSL-SAPGLDCTPRLPDFSPLQYQP-GIPLVPRGPPTDLWTSRPRQEAATRFFRP LLLKF-TASVVVSDSTPVPGSTPTRRGAF, (SEQIDNO:8582); XM_533428.5, HECA, Ins, G_7, GPLRRT-GAVPAAPGPVRAAHSHPQA, (SEQIDNO:8583); XM_014116933.1, SNAPC4, Del, G_7, GPLTPRDCQ, (SEQIDNO:8584); XM_548229.6, EPX, Ins, G_7, GPLVTGSSSTSDPAQ, (SEQIDNO:8585); XM_014107094.1, HSPG2, Ins, G_7, GPMPAT-GRCSPAGGPGASSSEHSTPRWLPLPAVPGQWEPT-SLLLLVS, (SEQIDNO:8586); XM_014120943.1, NAALADL1, Del, G_7, GPMWYPHTQPTLPREPHRAS-WSMPTREQKKIS, (SEQIDNO:8587); XM_005621642.2, LOC610677, Ins, G_7, GPPGAADRGQPAGVRT-GRAGSRLPGAPQGLPGDPQLAAAAALPAGL, (SEQIDNO:8589); XM_014109663.1, LOC102154979, Del, G_7, GPPGGVGCWGGGKQGLR, (SEQIDNO:8590); XM_542974.5, GDF5, Del, G_7, GPPMPGPRGAPGR-REA, (SEQIDNO:8591); XM_005640594.2, PIKFYVE, Del, G_7, GPPNSIQPAVRKMCLMDICWGPQIAK, (SEQIDNO:8592); XM_003639638.3, POGZ, Del, G_7, GPPQLSLKSFRLL, (SEQIDNO:8593); XM_543740.5, YARS2, Del, G_7, GPPRASETPAAAPR-SARRWRRSRCGGTRAPSAEAS-RPWRLITSGSSPTGGPGEASRS WTTRPGTRGSTWWTS, (SEQIDNO:8594); XM_860534.5, EEPD1, Del, G_7, GPPRLSPPALP, (SEQIDNO:8595); XM_540475.4, NPTX1, Del, G_7, GPPSGHSKPVARST, (SEQIDNO:8596); XM_537234.5, PYCR2, Del, G_7, GPPSMPCTS, (SEQIDNO:8597); XM_005637953.2, SULF1, Del, G-7, GPPSPTLL, (SEQIDNO:8598); XM_005616412.1, PRKD2, Del, G_7, GPQGGPVGRELRLPGAGKPPSARP, (SEQIDNO:8599); XM_845299.4, LOC608319, Del, G_7, GPQKLPKGEAF-LPGGRESRQLPWNQPPSPQSLGFRCLGGTRGIP-WFHREANSPSTPA APGRNLGPGGHGSRSQWW, (SEQIDNO:8600); XM_005637227.2, PIANP, Ins, G_7, GPQLCQSWISAPGLWFCSPPWAGNPTPQLRFHAG, (SEQIDNO:8601); XM_003639769.2, MISP, Del, G_7, GPQSSPRRPPSSGRSGWPRSGKRT-CGSGGGCGRPTPSRSWCRSPAGRC, (SEQIDNO:8602); XM_536612.5, PELP1, Del, G_7, GPQVRRCCPTCSVIS-PRRLTL, (SEQIDNO:8603); XM_005619991.2, EFNB3, Del, G_7, GPRAGAVRHLLPQTCFSLVTGQTWI-CASPSSSRSIALTSGAMSSARTTITT, (SEQIDNO:8604); XM_537649.5, CASC3, Del, G_7, GPRALRSRNVRVK-MASRAMLFCRIMKVQKTLKVKKGSIVKRKTPK, (SEQIDNO:8605); XM_005627365.1, PTCRA, Del, G_7, GPRAPRAPAGRQVHRRLPQPPPAGTPSAPAACTGR-SWGHARSPGAQAGRRGGSLPT ELGPGAR, (SEQIDNO:8607); XM_538784.5, MUSK, Del, G_7, GPRAPRGAP, (SEQIDNO:8608); XM_005622207.1, LOC102151417, Del, G_7, GPRARDTRAPRVAAR-PAGRGGPGTGPATRSS, (SEQIDNO:8609); XM_005630590.1, ADI1, Ins, G_7, GPRGACA-GRAGSGVHGGAQAGGLGDPPRPPCGAQAS-SAAAVGC, (SEQIDNO:8610); XM_005616412.1, PRKD2, Ins, G_7, GPRGAQWAGS, (SEQIDNO:8611); XM_540228.5, EGR4, Ins, G_7, GPRIW-GARLRFGEARSRLPRPVPASKGASAPRPLSQR, (SEQIDNO:8613); XM_847877.4, NUTM2F, Ins, G_7, GPRPCREDAPPWGPPQGLWAAGQGQGRGAASPL-TASKEKV, (SEQIDNO:8614); XM_005640564.1, ABI2, Del, G_7, GPRPLLMASLLQLPLLFLPLPLQVILFSSTV, (SEQIDNO:8615); XM_014115724.1, CEP170B, Del, G_7, GPRPRPGAPRGPSAVWDAAPVWPRTSWR-SACGRAPRPPGPALTRHPQHHRPPRHPV GPAPWPRR-PRHHPPPTPS, (SEQIDNO:8616); XM_014118775.1, LIMCH1, Del, G_7, GPRRHQLPSPKTEMPSKSR-SADGWSKLGSE, (SEQIDNO:8617); XM_005621756.2, PDIA2, Del, G_7, GPRRSPSRRRRSLRRMGSWC, (SEQIDNO:8618); XM_005631271.2, LRP4, Ins, G_7, GPSAGSCMHEDRHSVYPGQLGLPG, (SEQIDNO:8619); XM_005624035.2, LOC483345, Del, G_7, GPSAVSRWSSAPST, (SEQIDNO:8620); XM_014119242.1, LOC106559725, Ins, G_7, GPSGAGQSLDPSD, (SEQIDNO:8621); XM_005626753.2, PIGO, Ins, G_7, GPS-GRSVPRVLICGVRVQASPPRFRAPFK, (SEQIDNO:8622); XM_005626749.2, PIGO, Ins, G_7, GPS-GRSVPRVLICGVRVQASPPRFRAPFKDAEDLGAAL-PGLGQLPLLRRHCPLHQWL PAHSFGTHQP, (SEQIDNO:8623); XM_014118308.1, PRRC2A, Ins, G_7, GPSLQAPST, (SEQIDNO:8624); XM_014112998.1, UNC5A, Ins, G_7, GPSPSGPQCLQDPLPH-SAKDHYQPRPAL, (SEQIDNO:8625); XM_014111712.1, LOC106558448, Ins, G_7, GPSQGRRCLLFSGAIYPPPPT-PRAL, (SEQIDNO:8626); XM_014114499.1, FAM57B, Ins, G_7, GPSSGQHLGRGARLSAQGVPHGAPPR-RHGARMLPAVCGVASRQGRFLSRLLADG, (SEQIDNO:8627); XM_003435252.3, CDK12, Ins, G_7, GPS-SIFCLWKALSGAYKSPAKRGKRERSSLL, (SEQIDNO:8628); XM_546502.5, MPZL2, Del, G_7, GPSSLCSTTMWIPSNP, (SEQIDNO:8629); XM_005626855.2, CORO2A, Del, G_7, GPSSSFPCIR-RENWTPTTQRSAGTKGTS, (SEQIDNO:8630); NM_001007142.2, SLC5A2, Del, G_7, GPSSS-WVTPSMKWEGIQGFSTNTWGQ, (SEQIDNO:8631); XM_005621226.2, SLC5A2, Del, G_7, GPSSSWVTVGS-SAGGGGARRLSHRALSGGAETSCISSMVVLGTVLA-LAPGLLTTLPS QPSMKWEGIQGFSTNTWGQ, (SE- QIDNO:8632); XM_005631690.2, CDS, Del, G_7, GPTGRTQSSR, (SEQIDNO:8634); XM_014116730.1, ARHGAP33, Ins, G_7, GPTPTPQEPSTPHGPGPG, (SEQIDNO:8636); XM_540482.5, NPLOC4, Del, G_7, GPTRGNLLPWRTSVARLNQGARDTFRGLTASVL-SASQVPSR, (SEQIDNO:8637); XM_546946.5, ACHE, Del, G_7, GPVAMTQSWSPA, (SEQIDNO:8639); XM_014120762.1, NAMPT, Ins, G_7, GPVLARPERPEVSPRQSRSVPGPGRELERAGYSL, (SEQIDNO:8640); XM_538028.5, TIMM17B, Ins, G_7, GPVLHHRLWPGAPAGQRRSLEFHYQRSIDWGCAGCPQWPIGHGGL-SNDGGHPLGS HRGCWHPPYS-LYCPAVPQCTPVLGGPQPATP, (SEQIDNO:8641); XM_847033.4, FSD2, Del, G_7, GPVQGATP, (SEQIDNO:8642); XM_014107619.1, ECEL1, Ins, G_7, GPVR-PLRQSV ALVDGGFLQPL-PAQGGVHRPPVRQFHCLQPAGERKAHPW, (SEQIDNO:8643); XM_014106406.1, LOC102156658, Del, G_7, GPVSRCALILLSGESKTGVQL-GRKRKPLGGQGLTSRVRSGSLTPGGRYTCA, (SEQIDNO:8644); XM_014117418.1, CELSR1, Ins, G_7, GPWGAGFVLCPQDYQEASRPRLRLG, (SEQIDNO:8646); XM_548256.5, MMP28, Del, G_7, GPWGTPSCPA-GAKRTSTATSAGP, (SEQIDNO:8647); XM_014121791.1, NOTCH3, Del, G_7, GPWNQCPLRR-TRRRTRQPASSQT, (SEQIDNO:8648); XM_860329.4, KLHL42, Del, G_7, GPWPLTPTKGSPRPCSGMRR, (SEQIDNO:8649); XM_014113859.1, SLC22A31, Del, G_7, GPWQAFSLPSTWLAWSCVTPPTAWYSPRQLASSRC-WALCCCRA, (SEQIDNO:8650); XM_014106904.1, MMP15, Del, G_7, GPWRKPRL, (SEQIDNO:8651); XM_005639316.1, METTL14, Ins, G_7, GPWRSTQRWLSTSI, (SEQIDNO:8652); XM_005639039.2, C31H21orf58, Del, G_7, GPWVGWLLRGRCSLQMI, (SEQIDNO:8653); XM_005640095.2, HISTIH1T, Del, G_7, GQAHRRLL-VVAGRPKAPKTNSPGRAQARPPLGNPRRPSPGST-SRRSTRGRRCPRS, (SEQIDNO:8655); XM_014114526.1, KIAA0556, Ins, G_7, GQALHPGRLVG, (SEQIDNO:8656); XM_538101.4, TNMD, Ins, G_7, GQALLAGDTQKNI, (SEQIDNO:8657); XM_014113517.1, DVL2, Del, G_7, GQAVQGGPRNGPL-SPSPAAAVSLSPPAVGAASG-GAGSRVGLVMGALPLPEARQGVS PISEPTLG-SIPMGHPRGWPSPIIP, (SEQIDNO:8659); XM_005625037.2, PNPLA7, Del, G_7, GQEAVPR-LASSGPWQSVASLWTWSEGHLLGPSWVPCTPRSGT-TARSGSGPRSGLRT, (SEQIDNO:8661); XM_005620069.1, CDRT4, Ins, G_7, GQEEIRTRYLDL-RYEELFSDGGD, (SEQIDNO:8662); XM_003434552.1, OR10S1, Del, G_7, GQERGSLRSSTQSSLPCSTLSSTL-CATRRSSGLCKDF, (SEQIDNO:8663); XM_005628314.1, CPSF1, Ins, G_7, GQEWGSPGARGR-GRGAGAAGTPPSGPCTLR, (SEQIDNO:8664); NM_001110801.1, MAPT, Ins, G_7, GQGFRRRPRCG, (SEQIDNO:8666); XM_005641667.2, LOC102152628, Ins, G_7, GQGGREHSRSLSASGGTC, (SEQIDNO:8667); XM_533429.5, TXLNB, Del, G_7, GQGLM-PRKSVVFTML, (SEQIDNO:8668); XM_014121191.1, MADD, Del, G_7, GQGPVGRKDPVLLVPQKRLAL-RAQRVACPCSLPVLTLPPLM, (SEQIDNO:8669); XM_859534.4, WNK3, Del, G_7, GQGTQYSG, (SEQIDNO:8672); XM_003639620.3, SV2A, Ins, G_7, GQHCILERAGRVDR, (SEQIDNO:8673); XM_005641281.2, SLC9A7, Ins, G_7, GQHSDCK-WLLRLPHGLHKPRGQSENKEQLRGGAGPSPGNGR-PAGV, (SEQIDNO:8674); XM_534578.5, SFTPC, Del, G_7, GQKPSSAWPCRSVWAPLPPSPLAPLAS, (SEQIDNO:8675); XM_005633536.2, ARHGEF17, Del, G_7, GQLSVWPR, (SEQIDNO:8676); XM_003433503.3, LOC100683813, Del, G_7, GQPEEATGPGASPCAP-PEASRRSRSTRAS, (SEQIDNO:8677); XM_005633207.1, SAMD1, Del, G_7, GQPLLPLGPTPHPLCLCPQENQPCPGLMEPPLAVLL-GAKRSRLTLSSGR, (SEQIDNO:8678); XM_014109631.1, ITGA11, Ins, G_7, GQPPADAEGLPH, (SEQIDNO:8679); XM_014116554.1, LMTK3, Del, G_7, GQPRRKGSLDRGLPPSPPTR-ERPGHPQTRVPTHCRGPGRSRPL, (SEQIDNO:8681); XM_539968.5, ADGRA2, Del, G_7, GQQPGRPSRRPVRAAACTTARPTATRAAAATARASS, (SEQIDNO:8682); XM_003639488.2, NUPL2, Ins, G_7, GQQRSRKAIFWFLRFWSFN, (SEQIDNO:8683); XM_014121803.1, PALM3, Del, G_7, GQRAATQRPQER-RAGA, (SEQIDNO:8684); XM_014110417.1, SLITRK3, Del, G_7, GQRAHHLMSSRPLGAPCHFLC, (SEQIDNO:8685); XM_014107943.1, SGSM1, Ins, G_7, GQRGREA-QPGGQWGQSLRRARDGKSLPCPGFSGRGHFCQQ, (SEQIDNO:8686); XM_014111997.1, LOC106558481, Ins, G_7, GQRRGGGRGL, (SEQIDNO:8687); XM_541491.5, SCAF1, Del, G_7, GQRRRRRKRKKRRRRRRSSSLPPPQP-PAQLQRPQALPLARGPQPATQGQKMDRP PVSP-SCPRCPHPCPGTCLLVWTAPPAVSWP, (SEQIDNO:8689); XM_014120101.1, XKR5, Del, G_7, GQRWQVPH, (SEQIDNO:8690); XM_014114308.1, LOC102151519, Ins, G_7, GQRWWEDTAPEDKHIGAGRSACRRE-ALQVLRV, (SEQIDNO:8691); XM_014107197.1, TMEM230, Del, G_7, GQTEPFLS, (SEQIDNO:8693); XM_014109600.1, TYRO3, Del, G_7, GQWGPPPVTIGTSSALGG, (SEQIDNO:8694); XM_854764.4, MAP1A, Ins, G_7, GQWNSPSQAWP, (SEQIDNO:8695); XM_014111684.1, PLXNB3, Ins, G_7, GRAADPSQGHGPGRGAAAPAVGVAGGHSG-GAGCRC, (SEQIDNO:8696); XM_544915.6, PWP2, Ins, G_7, GRAAGQPGLQVRAPPVPLQGL-RAQRLLLSRWQEVRCHKRQPRSDVPRPWEEAGVQ RVCPGQNLLWAVR, (SEQIDNO:8697); NM_001286967.1, ARHGAP18, Del, G_7, GRAARGGRR-PRPAVNMASAR, (SEQIDNO:8698); XM_014120910.1, RTN4RL2, Ins, G_7, GRAHGGRLLGGLRRRGPARRAD-VPGRGLPGAPGLPRPRALGRAAQPSALPPAPGAP PP1, (SEQIDNO:8700); XM_014120941.1, DRAP1, Del, G_7, GRAHRGVRGTNAPPPSVPSRRPGPQPSLPGEPLSLAP-STPFGDGGDRVRVFCPLPRRG SRRSCKLTKRL-GRWRRQCLSSSPGRSSCS, (SEQIDNO:8701); XM_547541.5, UBQLN4, Del, G_7, GRAPEDRGPARC-TRQSRTPLGSMRLAWGQGCSTAQR-CRPSSSRSLKTPN, (SEQIDNO:8703); XM_014112067.1, LOC106558506, Del, G_7, GRARAPRGRA WRRRAL-PHPSCAPQCTRARRRRRPLPPPRRAPLSGWASA-DREQEECG, (SEQIDNO:8704); XM_005623080.2, MTCL1, Del, G_7, GRARGARRSPHCWGPSTRG, (SEQIDNO:8705); XM_539936.4, MNX1, Ins, G-7, GRASAPTPV, (SEQIDNO:8707); XM_846645.3, CCDC184, Ins, G_7, GRATCGAPRPARHYPAAAGGR-GLSV, (SEQIDNO:8708); XM_005618215.1, LOC102151979, Ins, G_7, GRAVLAAKA, (SEQIDNO:8709); XM_538245.6, LRP1, Del, G_7, GRCIGRTGGQTR, (SEQIDNO:8710); XM_535876.5, FL3A1, Del, G_7, GRCPEESTCKTIFMLQIFTCSRRDGTPIKWTTTLT-SMKTTS, (SEQIDNO:8711); XM_005642072.1, LOC102152098, Del, G_7, GRCRWRSWRTRGRRWL-WRARPTALRFFSFPQVKI, (SEQIDNO:8712);

XM_543042.5, KCNB1, Ins, G_7, GRCSCCRWTGVCHTLGQACTESRVLHLHHSKC, (SEQIDNO: 8713); XM_005628665.2, JAZF1, Ins, G_7, GREALRLPGSWM, (SEQIDNO:8714); XM_537179.5, PAPPA2, Del, G_7, GREAPRQDTVSQMPQGAWL, (SEQIDNO:8715); XM_005620161.2, RAI1, Ins, G_7, GREGGGGRGPLQPLQEDVFSQED, (SEQIDNO:8716); XM_536894.5, EIF3B, Ins, G_7, GREIQTNPEIQPPRGSAH, (SEQIDNO:8717); XM_014113085.1, SAL13, Del, G_7, GRFLTRHCQRASRTPWTLSCLTTTRRQRPSAATMMTRTRTPWRTTPSYRSRPATRPS HSWPTPAPARPHHPPSSPASPP, (SEQIDNO:8718); XM_546596.5, FXR2, Ins, G_7, GRGAGTARRGARLQRGLLQGLCEGCP, (SEQIDNO:8719); XM_014112349.1, BOD1L1, Del, G_7, GRGAGVRPAEPSGGERMEDRWPQRWKWKDAARSAWCTAAGKGRVRRALPRVGR GAPRGRTLCQMSE, (SEQIDNO:8720); XM_005639081.2, SHROOM3, Ins, G_7, GRGAPARAQRPPPRGTATGGPSPEGAARRR, (SEQIDNO:8721); XM_014122263.1, SHC2, Ins, G_7, GRGAPGRRRRRRVDPQGQLHPQAGARLAAPRRQGPGARGLIHRAVHGLHRSPPLH ALSGF, (SEQIDNO: 8723); XM_005637620.2, WNT8B, Ins, G_7, GRGAQTREKIL, (SEQIDNO:8724); XM_014119803.1, LOC102156916, Ins, G_7, GRGARGARGARGA, (SEQIDNO:8725); XM_005623276.2, NFATC4, Del, G_7, GRGEAVFSNAPASASPPSLPRLTRRPRWRTTRMPGETAPPGITPRRKALGATERQGA RAGAPSSAPALAAAACPRGASSPTLPTRQPCTQPATRWSPS, (SEQIDNO:8726); XM_014114657.1, DNAJA3, Ins, G_7, GRGGGFAEPQAERQYLRAFPGRSGLRGTADIDTRCQLQRSKKLPFCLYCLLPHELPF GQRGLLPDTRSAPKCQPEGDQESLLPAGQEIPPGHK, (SEQIDNO:8727); XM_541491.5, SCAF1, Ins, G_7, GRGGGGGRGGRRGGGGGGGAAACHHHSHQHSCSGPKHCP, (SEQIDNO:8728); XM_546031.5, MBLAC2, Ins, G_7, GRGGPAPAGRGHPRALRPLRGPLPVRPGGGASRRGRGAGSRGQL, (SEQIDNO:8729); XM_014109869.1, COL18A1, Ins, G_7, GRGGGPGSWGALPGAGGDAGEVSGAWGQGPQAAGHPRAPRKWRKRGRRESVADPG PLSRRPAPLRPPPARG, (SEQIDNO:8730); XM_005638695.2, C2CD4A, Del, G_7, GRGGRGGRRAPRRRVPR, (SEQIDNO:8732); XM_005624842.2, KSR1, Ins, G_7, GRGGRGRGPRGRGQPGAAAVRAAPEAHRHLHRQPARAAHQVRGVQRPHPAGDPD PGGKAGPVHLQTAAVQAECGSWREDPRAQQLPPFQ, (SEQIDNO:8733); XM_005638695.2, C2CD4A, Del, G_7, GRGGRRAPRRRVPR, (SEQIDNO:8734); XM_014120406.1, GPAT2, Ins, G_7, GRGGVHTLT, (SEQIDNO:8735); XM_005623276.2, NFATC4, Del, G_7, GRGKNWTQRTPRHAAVWPWGSPLPMALPLLAFPGLHPLGLACIRHHPARPPHLALG RASLPGQ, (SEQIDNO:8736); XM_003639660.3, B4GALNT4, Ins, G_7, GRGLGAPGQGPAGRAGGGTAPTEEFLPPLPLQAGHVGHAQPEGLPRGEPV, (SEQIDNO:8737); XM_014121842.1, LOC106560109, Ins, G_7, GRGPAGRSGQEPGEAGSVRHVPGAGLRRDRKRKWLLGGARGSAGARA, (SEQIDNO: 8738); XM_014110905.1, LOC106558304, Ins, G_7, GRGPGGPRGDRPGEPGSARWATRRDGSAGRPLFRP, (SEQIDNO:8739); XM_005622956.2, LOC102153244, Del, G_7, GRGPPKERANQARRSLQELS, (SEQIDNO: 8740); XM_848801.3, THAP10, Del, G_7, GRGPRRTPRPSPPRPRAQPAARGPGPGGGPRPHRLHVKMKLNKHKSLLINLIVSLQY LLTVKKAQCIKVHSCL, (SEQIDNO:8741); XM_005634649.1, CHST2, Ins, G_7, GRGPSPQWHSGPRGWRRQEAVGVRVHHVALGLIVLR, (SEQIDNO:8742); XM_540364.3, INHBA, Ins, G_7, GRGQGAVPQTFPHAAGPPV, (SEQIDNO:8743); XM_014116204.1, TMC6, Ins, G_7, GRGQRPGHAAGGSREGLGPVPVQP, (SEQIDNO:8744); XM_843208.4, SPATA24, Del, G_7, GRGRCVSPSINCGT, (SEQIDNO: 8745); XM_005637906.2, TUBGCP2, Ins, G_7, GRGRGLHRDDAEEPDPERDDHRVRAQRQG, (SEQIDNO: 8746); XM_538784.5, MUSK, Ins, G_7, GRGRRGERL, (SEQIDNO:8748); XM_537768.5, RILP, Ins, G_7, GRGRTEAEVRAGNRRRWSSGDP, (SEQIDNO:8749); XM_014106881.1, LOC106557667, Del, G_7, GRGSFISWFRSFP, (SEQIDNO:8750); XM_014112065.1, LOC491446, Del, G7, GRGSLPGARGALPWGVAAPGLSSAAVLPPGACAPSPSLGDPPAADGL, (SEQIDNO:8751); XM_005629427.2, ACSS3, Ins, G_7, GRGSPAQRPPPPRAAPASSRPHPRLQPSRLLEPLQVFRAGCGLGE, (SEQIDNO:8752); XM_537674.5, MYCBPAP, Del, G-7, GRGVAGVSRSLVVPGPAAQGHAISARAAP, (SEQIDNO:8753); XM_005623182.2, TSHR, Del, G_7, GRGVLLPPVSATRRMTSESPARISTASPPYHPARRL, (SEQIDNO:8754); XM_014119248.1, DLGAP3, Ins, G_7, GRGWGRQQHLPQDVPWPGPLRHL, (SEQIDNO:8755); XM_005626758.2, FAM214B, Del, G_7, GRHPPGSTRYPSFPLQLVPLSLIGP, (SEQIDNO:8756); XM_014122402.1, C2CD4C, Ins, G_7, GRHQGQRG, (SEQIDNO:8757); XM_014111463.1, LOC106558415, Ins, G_7, GRHTAPAGTWPLPPKCPTALQMHRVPQGPRGLHPGHPNPHVRG, (SEQIDNO:8758); XM_538049.4, SMC1A, Del, G_7, GRKQWRLWPCSLPSTATSQPPSSSWMRSMLPWITPTLARWQITSRSSRLATSRPSSSL SRRSSTPRLRASLESTPSKGTV, (SEQIDNO:8762); XM 005624449.2, MLX, Ins, G_7, GRKTRGFLAVPKGPPALRAPGLQRRQLSPRACQGGICLQR, (SEQIDNO:8763); XM_014116165.1, KIF25, Ins, G_7, GRLLRQSPGRVPGGPAAQGAGACQAAARGPGG, (SEQIDNO:8764); XM_005632180.2, PRRT3, Del, G_7, GRLPRPVPALGARRRLWAAAPRVARGCPAAAWGPRRRRASWTCGRRRPST, (SEQIDNO:8765); NM_001005760.1, LIFR, Ins, G_7, GRLQATDAPPRHFYCRRPRCRGRPR, (SEQIDNO:8766); XM_005640955.1, LOC488614, Ins, G_7, GRLSHLSDRDCTDIQGLLLQPQPRQTLLLPHADSGEAGLYRQQPH, (SEQIDNO:8767); XM_542654.5, NALCN, Ins, G_7, GRPAGLRGPREAPEEDRTVAAALSTKTNKPLSVFGQLTICRAHNNEIRSVQNEPHDR HGVVWFRG, (SEQIDNO:8768); XM_014112772.1, LOC106558673, Ins, G_7, GRPAQCKLE, (SEQIDNO: 8769); XM_005616850.2, CACNG8, Del, G_7, GRPASSRCTTPSRRRAAASRSRSPGRPPRPRPPRPRPPRRPPGPWPRRPPPPTPTRSTG KPRRC, (SEQIDNO: 8770); XM_005639649.2, SEMA5B, Del, G_7, GRPCTPGRACGGWARACRSAAQRPLPSRRRSRRATPRAASKCGATPRGRRGCR, (SEQIDNO:8771); XM_014109910.1, KHDRBS1, Ins, G_7, GRPGLARHAATTAAAALGHGPRRDGGRSGADPAAAPLSHCLRQDGAGEQVPARTH GREGLARPVLHSRHAATDGRN, (SEQIDNO:8772); NM_001201331.1, MBOAT4, Ins, G_7, GRPGLSCYGSLCCAGLHPCSVCHGSDLLAGPTGCPQVGFPLSDGLADAVSPGAAVY, (SEQIDNO:8773); XM_005616764.2, LOC102156806, Ins, G_7, GRPGPQRALRQPLTVPERREHPAPTKASRGL, (SEQIDNO:8774); XM_005621041.2, FBXO24, Del, G_7, GRPKPVRSTSARSTVAPPCRIAWKR, (SEQIDNO:

8775); XM_014108780.1, LOC106557931, DEl, G_7, GRPLIWNLDPGAPLQGWCPGRGPGAVRRLPLGAREEEETQPAARAAGGPRLSPLGG RRAEGAG, (SEQIDNO:8776); XM_005616873.2, CD3EAP, Del, G_7, GRPPGPERAGSEGHPRAPTPHGRSRTRPRPLVPRGLRRGSSGSGYWG, (SEQIDNO:8777); XM_540520.5, PTDSS2, Ins, G_7, GRPPQHRVRGVRRRHQHLLLASPHPDCALHPHLCAWLRDSAGGDAPGHSL, (SEQIDNO:8778); XM_843371.3, LOC606890, Del, G_7, GRPRAQLPLPPP, (SEQIDNO:8781); XM_003640189.3, FZD5, Del, G_7, GRPRGPSAPPGPRRCASAASPSCPS, (SEQIDNO:8782); XM_005638627.2, LMAN1L, Del, G_7, GRPRGTASGSSSTPRPRTPRALSSACWPVMGTLASSRTGTEPAASWAPAAGTSATCH DPSRHGSRTGGTGCVCP, (SEQIDNO:8783); XM_014109646.1, LMANL1, Del, G_7, GRPRGTASGSSSTPRPRTPSRALSSACWPVMGTLASSRTGTEPAASWAPAAGTSATC HDPSRHGSRTGGTGCVCP, (SEQIDNO:8784); XM_005620267.1, LDLRAD1, Ins, G_7, GRPRPPLLLAPGSLPLCLLAAPAGDSRSPDRPGYHPWTPTTHTRGPGLCDANKQDRL PVPRPEELHPSQRGL, (SEQIDNO:8785); XM_014108067.1, RNF152, Del, G_7, GRPRRRRRRSQTGGARRKAPPGPGCAL, (SEQIDNO:8786); XM_005616884.2, MAP3K10, Del, G_7, GRPRSGARPPRGPSGPRCSTTRRRAMRS, (SEQIDNO:8787); XM005640052.2, JARID2, Del, G_7, GRPSPPGTPSMASRSVAG, (SEQIDNO:8788); XM_014107197.1, TMEM230, Ins, G_7, GRPSRSCPDHWHSGVPARILPPAHCLLCFQRLPGLLLR, (SEQIDNO:8789); XM_005630813.2, SNX27, Del, G_7, GRPTGPGCARGTASWR, (SEQIDNO:8790); XM_543274.5, IRS1, Del, G_7, GRPWGAAVAAAARRI, (SEQIDNO:8791); XM_014113517.1, DVL2, Ins, G_7, GRPYREARGTGP, (SEQIDNO:8792); XM_014122606.1, ST5, Del, G_7, GRQAHPWRGKAVAPLSQGPLEIARALSCCHPRAPLIPL, (SEQIDNO:8793); XM_014114950.1, LOC100856175, Del, G_7, GRQALETAQETMGEGVQAPR, (SEQIDNO:8794); XM_542974.5, GDF5, Ins, G_7, GRQCQGQGGHRADGRPDTAQEG, (SEQIDNO:8795); XM_540482.5, NPLOC4, Ins, G_7, GRQGEICCPGEHQLQD, (SEQIDNO:8796); XM_014112352.1, LOC102153630, Ins, G_7, GRQGVRSSREERQQESGRGKARERALTFGGAVLGAADEK, (SEQIDNO:8797); XM_549367.5, IRAK1, Ins, G_7, GRQPGAELGRWPRAPADSCGRITVEQLRVIAATADRHQPGPTEDGAEAGLVRGRGP GQPAAAVL, (SEQIDNO:8798); XM_014114417.1, XYLT1, Ins, G_7, GRQPPVHIPAEHARPPGDDRLAMGLLHQPQRSRLPHQDE, (SEQIDNO:8799); XM_005632813.2, NACCI, Del, G_7, GRQRQQRWRQQGVW, (SEQIDNO:8800); XM_005617510.2, KIFC3, Del, G_7, GRQVWPPWCIGWWRPCPSCRRRKLGYRRSWQPFRRGWPSKTVTSKPHPPSCRTRW KT, (SEQIDNO:8801); XM_005633206.2, LOC102152641, Ins, G_7, GRRAGPVGTAGRADRAGAGHQQ, (SEQIDNO:8802); XM_003432153.3, EMILIN1, Del, G_7, GRRAWAGGSVPLTAPCCSWRTSFTSSV, (SEQIDNO:8803); NM_001048128.1, RING1, Ins, G_7, GRRAWGGRGGWRGCELRLRP, (SEQIDNO:8804); XM_014119253.1, LOC106559727, Del, G_7, GRREERGK, (SEQIDNO:8805); XM_014107257.1, ARFGAP1, Ins, G_7, GRRGGQSQDRQEGCAAGRAG, (SEQIDNO:8806); NM_001048121.1, HSF4, Ins, G_7, GRRGRAGPGPKRV, (SEQIDNO:8807); XM_846313.4, CENPB, Ins, G_7, GRRGVGGGRGGGRGG, (SEQIDNO:8808); XM_539968.5, ADGRA2, Del, G_7, GRRPAGRGSRSPRAPGASLPPATQLICTIGAERTRVWPRRTARGRPAPGTGSGRCAG GQQPGRPSRRPVRAAACTTARPTATRAAAATARASS, (SEQIDNO:8810); XM_014110496.1, LDLRAP1, Ins, G_7, GRRPASQAARELDRHSGDTARGNALQPQVPGHDAGGAAQG, (SEQIDNO:8811); XM_014109054.1, SORCS3, Del, G_7, GRRPKSSGCPAPRSR, (SEQIDNO:8812); XM_005639643.2, CCDC80, Ins, G_7, GRRPRSQGQGQGGQKAREAREAREAREAREGEEEEAEKREGRQVAQGEEGKG, (SEQIDNO:8813); XM_005641746.2, LOC102154334, Ins, G_7, GRRRRRRRRGGGGGAPAAAGRGLRSRRGAAAPGPAAAPPPRLVHPVGAEGAGERF PTRSIP, (SEQIDNO:8815); XM_014106692.1, NPHP3, Del, G_7, GRRRRRRRRGRGPGRGR, (SEQIDNO:8816); XM_005640095.2, HISTIHiT, Ins, G_7, GRRTEGCL, (SEQIDNO:8820); XM_543127.5, FREM2, Del, G_7, GRRTLRPSPVLWP, (SEQIDNO:8821); XM_014122475.1, SYT9, Del, G_7, GRRTVPMASVYSAKSQSQPRRPGIIQSEDNSTCQTQTSISSSFKNRNS, (SEQIDNO:8822); XM_014119666.1, EML2, Ins, G_7, GRRWLWRGDGGARPGLLRPLRHVLAASILQR, (SEQIDNO:8823); XM_014116598.1, SIX5, Del, G_7, GRRWRRRRPKKRRRKRASSCRLCRRPRVRRRPRPRPGPGRAKRRRERRARDPRASP GRPPRPLPSRPRASASRPSRWRASARRCYRRATPAA, (SEQIDNO: 8824); XM_005620294.2, IGSF9B, Del, G_7, GRSCCGRSPPRRRYLLREHIHLHPGTLLHLRGWRL, (SEQIDNO:8826); XM_005633056.2, UBXN6, Del, G_7, GRSCRRRTAWPSTSAGWCPRPS, (SEQIDNO:8827); XM_003434552.1, OR10S1, Ins, G_7, GRSGGPCGLLHNRHSHAQPFHLHSAQQGGQAGSAKTFEPRPAGVPVRQPAPL, (SEQIDNO:8828); XM_533011.5, RSBN1, Del, G_7, GRSGHLNVCLWVKWLRRSERCA, (SEQIDNO:8829); XM_538306.5, KLHDC7B, Del, G_7, GRSGTPTPC, (SEQIDNO:8830); XM_005622611.1, CNST, Del, G_7, GRSRSAAPRPRGSCPPSPGTPARMTAACSCLSRGPAEMWPQ, (SEQIDNO:8831); XM_014117371.1, TMPRSS6, Del, G_7, GRSSLTAG, (SEQIDNO:8832); XM_535292.4, SLC12A3, Del, G_7, GRSTGWTRREKRSFPC, (SEQIDNO:8833); XM_014118581.1, TMEM74, Ins, G_7, GRSVLFANDVYVERGAVSSQQVCLFQRVCKTLRFFQLQDENLH, (SEQIDNO:8834); XM_005616884.2, MAP3K10, Ins, G_7, GRTEQGAGRPPGAPSCAGQLGCAGGPGHELPTQ, (SEQIDNO:8835); XM_014118662.1, ARHGAP39, Del, G_7, GRTRPACSSSRRSPTAPCSSPSGGRRPS, (SEQIDNO: 8836); XM_014121783.1, PTPN23, Ins, G_7, GRTTPASCRSALCPSSPVLRTRDGPGGSASHDHCG, (SEQIDNO: 8837); XM_536512.5, PDZD2, Del, G_7, GRVAASRGTAAPGRGGAAP, (SEQIDNO:8839); XM_858228.3, EMC10, Ins, G_7, GRVAHSPASCCPGAHAAAAGGL, (SEQIDNO:8840); XM_014117996.1, C11H9orf152, Ins, G_7, GRVGESGDQGGRANARSLGGGCPPGMRV, (SEQIDNO:8841); XM_014119127.1, LUC102151792, Ins, G_7, GRVHHQLQGPPGEPDG, (SEQIDNO:8842); XM_014121191.1, MADD, Ins, G_7, GRVPWEGRTPCYLCPRRDWH, (SEQIDNO:8843); XM_005630877.1, LOC102151356, Del, G_7, GRVSCVRAPGAPAAPIGSPALRGGRRGGPRGAVSARGWESSQEPGDRLPPPARPPRA PRPRP, (SEQIDNO:8844); XM_005617924.2, LOC102154107, Ins, G_7, GRVSGFGC, (SEQIDNO:8845); XM_014121835.1, JSRP1, Del, G_7, GRVSPSGLEGAPPQWPPARPPPLCSP- PAEPIGPRRCPRPPVAARPGRSPSSDCQVPAAV RHPPSSDPQLRSPAPIWAPPSP, (SEQIDNO:8846); XM_005616796.2, C1H19orf12, Ins, G_7, GRWGPVGRVDDKRTVSADSSDPDAAAAL, (SEQIDNO:8847); XM_014119866.1, ADNP2, Del, G_7, GRWLMMMLFRF, (SEQIDNO:8848); XM_005629424.1, ZNF219, Del, G_7, GRWLRCTRAPPRAPGSPHLPRGRRPGPRRRKRTGC, (SEQIDNO:8849); XM_005629104.2, B4GALT2, Del, G_7, GRWSACARPCSFSACCTFSWPSSSTLTSTPSTWPS-SAASAPVALPAPSTQLPAAAPTS PGPTPRP-PARGSPRLPAPVLAPRLPSCLPVPTRRLVLWAGC, (SEQIDNO:8850); XM_541885.4, BSN, Del, G_7, GSAASRPLSSIARAAMAMSWTWAKALT-PAWSGSLSWRWRA, (SEQIDNO:8851); XM_014107981.1, ARAP3, Ins, G_7, GSAELGGRSAGSRN, (SEQIDNO:8852); XM_014111700.1, LOC102153373, Ins, G_7, GSAKFGAPR-PAAPGPRGPPGRAPAPSGCRSSRRPSVRGQRRPGPH-PAPSGQHLAAGR QRGVSWARAPPAAGARH, (SEQIDNO:8853); XM_003639620.3, SV2A, Del, G_7, GSALHPGTRWTC, (SEQIDNO:8854); XM_538573.4, GRM6, Del, G_7, GSALPSPSRFPGNQSQENSIR, (SEQIDNO:8855); XM_005640836.2, MIA3, Del, G_7, GSAPHLPRLTCLRDRSLLR, (SEQIDNO:8856); XM_005637080.2, PDE3A, Ins, G_7, GSARPARAGRRGGSLAVAPGRGGGAQLRGRRDMAGAE-AEAGRPHGRRD, (SEQIDNO:8857); XM_005616765.2, PEPD, Del, G_7, GSASRRTSW, (SEQIDNO:8858); XM_014112350.1, UCHLI, Ins, G_7, GSCPFGGGGPVPRRLVLPPLPLRRHPKCVRPALYSR-GLGGSARCFSRCLGSGSSRAPP RCSSSRWRSTPRC, (SEQIDNO:8859); XM_537686.5, COIL, Del, G_7, GSCPRPRARAWY, (SEQIDNO:8860); XM_843818.3, LST1, Del, G_7, GSCSWLCSFCPPVCVGFIGK, (SEQIDNO:8861); XM_014120777.1, LOC102153599, Del, G_7, GSDCGSLGGGPDPRCPRRSHRRL, (SEQIDNO:8862); XM_005633536.2, ARHGEF17, Ins, G_7, GSFPCGQGELSCIPSQSGRLPWQQPLFQHRDPQG, (SEQIDNO:8864); XM_541606.3, LOC484492, Del, G_7, GSFPLVPHQYPSWGMCCKSVLMPLFSLL, (SEQIDNO:8865); XM_533169.4, MPEG1, Del, G_7, GSFRNAPSSR-GRRPPSCAKPWSRGTPSLVLSPAPLATPPSTCYPR-STRRATTTWSAGA SAPSSSSARRCAKTCSGWRRLNLGLFGV, (SEQIDNO:8867); XM_548206.3, WFIKKN2, Ins, G_7, GSGCDHLGERPQRHGLPRGRVPEAPRQRGLRRGAD-PLALRRAGQQLPHLHLRPLPP QPEPL, (SEQIDNO:8868); XM_005635711.2, CCAR2, Del, G_7, GSGLPLW-MASTPRATRRC, (SEQIDNO:8870); XM_014121211.1, TRMT112, Del, G_7, GSGLTASPERGAGRPEMT, (SEQIDNO:8871); XM_014120700.1, MTMR11, Ins, G_7, GSGPEFQHRPPEGGARP-GALWTKVRPEDWDAGAQELSA, (SEQIDNO:8873); XM_538841.5, SKIV2L, Del, G_7, GSGPGSWRS, (SEQIDNO:8874); XM_541491.5, SCAF1, Ins, G_7, GSGPRQGQR, (SEQIDNO:8875); XM_005629022.2, SLC5A9, Ins, G_7, GSGRVLQPGP-GAAGRPVQAVWQAAGGLALRAPRTPRASTEPRGRG-CAQPGTDQHR RGAALEKRLRRPGH-PAAGHQRLPVGLLCV, (SEQIDNO:8876); XM_005617043.2, ZNF438, Del, G_7, GSHFLANLNP, (SEQIDNO:8877); XM_542293.5, CAPN5, Ins, G_7, GSHQRLHQGGDSSSRHGGPPCVWPGEGPRVCHH, (SEQIDNO:8879); XM_005636883.1, KMT2D, Ins, G_7, GSISWSGPPSETPFLPSK, (SEQIDNO:8880); XM_548355.4, NDOR1, Del, G_7, GSLALMPLT-TLPDSSGHCASRVRHGP, (SEQIDNO:8881); XM_014109402.1, TP53BP1, Ins, G_7, GSLCEAAPFKCP, (SEQIDNO:8882); XM_003435632.3, MORF4L2, Ins, G_7, GSLCREPPFRISEEDQKEQTEDTWKR, (SEQIDNO:8883); XM_005633810.2, OTOG, Ins, G_7, GSLHTICCPTEEHHGEDGHPVQASVPALLDIWPCPG-YAHRTHTCCGPHSCYLGT, (SEQIDNO:8884); XM_843959.4, LY6G5B, Del, G_7, GSLNAWVTWPPCP, (SEQIDNO:8885); XM_536856.5, PLOD3, Del, G_7, GSLPPGCFWLCL, (SEQIDNO:8886); XM_014119706.1, E2F7, Ins, G_7, GSLRSAAPPGH-SVHGPAVSHAGPVSRALLSHRAQAGLLCRRRA-PRCGACAFRGAQP GIHGSPPHRPHKRG, (SEQIDNO:8887); XM_003433650.1, VENTX, Ins, G_7, GSLRSRQGVQQRGAPARCGRGGGQVFRSVCAP-DAHGWVGQGRGRPAGAPRAHGL HRRAAQHPGERL-PAAPLPGPPGAPAPGP, (SEQIDNO:8888); XM_005639548.2, FBXO40, Del, G_7, GSMWNSTVSV, (SEQIDNO:8889); XM_844641.4, C6H7orf43, Del, G_7, GSNPLKGPRRA, (SEQIDNO:8890); XM_005638718.1, MAN2C1, Del, G_7, GSPGGGVPARGSGRSGP-SAATCGPH, (SEQIDNO:8891); XM_014116168.1, XRCC3, Del, G_7, GSPRGPSA, (SEQIDNO:8892); XM_005619964.2, PHF23, Ins, G_7, GSPSPRAANTP, (SEQIDNO:8893); XM_005624539.1, MS1L, Del, G_7, GSQRPRAPAAVPDPSIRRCCPFR-RALSWRRPKSLRPGLGTRVGRLPQLPPPRTRRDPH HYLCRGRHPSRPPPPPGPWRPARADGRV, (SEQIDNO: 8894); XM_005631571.2, C18Hllorf84, Del, G_7, GSQRQGVAC, (SEQIDNO:8895); XM_003639963.2, SLC48A1, Del, G_7, GSQVCWRCGCW, (SEQIDNO:8896); XM_847066.4, PAXBP1, Del, G_7, GSRCRARGCRRLPR, (SEQIDNO:8897); XM_014119335.1, MYCL, Ins, G_7, GSRERSPRRGSGERRPRGKGRSG, (SEQIDNO:8898); XM_014117421.1, LOC106559393, Ins, G_7, GSRIGKTSVKGAPGGSAGEASLL, (SEQIDNO:8900); XM_005636092.2, TMEM132D, Ins, G_7, GSRLHAPVPACHGAGLDPVCGRGGGRPRRAPGP-PAGLRLAGGHHGASE, (SEQIDNO:8901); XM_014121831.1, TLE6, Ins, G_7, GSRLLGSG-STAPVWSPGRP, (SEQIDNO:8902); XM_003638869.3, ZNF367, Del, G_7, GSRNRRRRSSPPAPASATSWCTR-GAGARTRTT, (SEQIDNO:8904); XM_544960.5, NKX6-1, Del, G_7, GSRPWAAPHSSSQPPPPMASTTS, (SEQIDNO:8905); XM_014107348.1, AMER2, Del, G_7, GSRRRPGKPRSPGPPGSCALGRAGRPTT-PAAPAAPGTAPATRKAAAAAAPLTPAPST RPQTRRQSLFVSCFLT, (SEQIDNO:8906); XM_005619097.2, LOC102151313, Del, G_7, GSRRWRVRTWTPGLRTRPKTPRAKRTARFWM, (SEQIDNO:8908); XM_014114950.1, LOC100856175, Ins, G_7, GSRSQGWFGGSWENWARG, (SEQIDNO:8910); XM_014112188.1, LOC106558557, Del, G_7, GSSCSRN-SSPLPAA, (SEQIDNO:8911); XM_014120407.1, FAHD2A, Del, G_7, GSSISTPLTPHCPRR, (SEQIDNO:8912); XM_014114292.1, KLK8, Del, G_7, GSSLKTTGSSQQPTVKKGSTQYAWGITA, (SEQIDNO:8913); NM_001037345.1, CYP2A13, Del, G_7, GSSLQDPPHCPSSEITCS, (SEQIDNO:8915); XM_005616252.2, KLK12, Del, G_7, GSSLTAGGSSQLL-TAVAAGTGCAWGSIASAGWTGRRRFGEVASP, (SEQIDNO:8916); XM_539968.5, ADGRA2, Ins, G_7, GSSRGARAAVQ, (SEQIDNO:8917); XM_003434804.3, PRRT2, Del, G_7, GSSSSSPPASST, (SEQIDNO:8918); XM_014120227.1, CMPK2, Del, G_7, GSSTCPRPII-LYTSGPGTCSNPTWFCCSQ, (SEQIDNO:8919); XM_005627878.2, SYBU, Del, G_7, GST- GAAVSWWISWPWLPPWSPPFCGHSVLGGGARIPSTT-SEPCSGAAAWSPCIRCAA PPSTSKP, (SEQIDNO:8920); XM_005619566.2, FLI1, Del, G_7, GSTPTPTCPATLTPTCPHT, (SEQIDNO:8921); XM_005626080.2, EPAS1, Ins, G_7, GSTRQQHFTSGME-KDEEPQGQRELPFDSRQTAECKHPQ, (SEQIDNO: 8922); XM_540643.3, LOC483524, Del, G_7, GST-SKNTR, (SEQIDNO:8923); XM_546641.5, TRPV2, Del, G_7, GSTSWWASYGTSGGVVCSSGSPSWTATLNCSS-WSRPCSQCCPRDCVSWPWSGTCLC LCLPWCWAG, (SEQIDNO:8924); XM_005625012.2, PTGS1, Del, G_7, GSVAPSLGGLMVERSRPSGNMEQGEGLSGE-IFWKMQE, (SEQIDNO:8925); XM_854764.4, MAP1A, Del, G_7, GSVELTIPGLAMTHPLSLNQTLAHPLLALM-CAWLTLRGSVQNLEG, (SEQIDNO:8926); XM_014116300.1, LOC100856218, Del, G_7, GSVM-RAEIDTWCRWPSCP, (SEQIDNO:8927); XM_014111404.1, FRMPD3, Del, G_7, GSVWEHPTIGS, (SEQIDNO:8928); XM_844620.4, C5H17orf74, Del, G_7, GSWPACHLPLSTSPLSCAACPSAWRPSQN, (SEQIDNO:8929); XM_535802.5, NDUFS6, Ins, G_7, GSWPPESVHKPGQRNKNGDVRLLWTAVQTSPSL, (SEQTDNO:8930); XM_014115404.1, HAX1, Del, G_7, GSWRVIQEVNPPNQHQTGAPRDLLVCLMICGL, (SEQIDNO:8931); XM_005620294.2, IGSF9B, Del, G_7, GTAAPARLA WTPGGTSPSPGPGPAPGRP-GAPSPVYIKWCYSRPGSRLSPKAP, (SEQIDNO:8933); XM_541287.5, TMEM2, Del, G_7, GTAPRRSWMA-FLFITASHGASPCMGQMAC, (SEQIDNO:8934); XM_005619266.1, LARP1, Del, G_7, GTAQATTPHVPR, (SEQIDNO:8935); XM_014114308.1, LOC102151519, Del, G_7, GTAVVGRHCPRR, (SEQIDNO:8936); XM_005624044.2, CYTH1, Del, G_7, GTCPRSCSG-ICMRA, (SEQIDNO:8938); XM_005624372.2, HEXIM1, Ins, G_7, GTEARGRASRTAMS, (SEQIDNO:8939); XM_536371.4, TET1, Ins, G_7, GTEIGIKPTSPRKCNQK, (SEQIDNO:8940); XM_846645.3, CCDC184, Del, G_7, GTGHLWSPSTRPTLPCCSWRARPLC, (SEQIDNO:8941); XM_014114637.1, LOC102151838, Del, G_7, GTGMWVLWRRDVCGFISPHHGRVV, (SEQIDNO:8943); XM_014119666.1, EML2, Del, G_7, GTGPRLGLGGPAVAVAGRWRSAARPSAASTTR-PRCFNTATMTICRARAAWRWTTA CRRWSSGCSCRKTSSRS, (SEQIDNO:8944); XM_005630084.1, LOC102155720, Del, G_7, GTGPR-SQPTSRSRATGCGGKAAGMRLPRVRGRATLR-GAVRPNGTCILSINLKDMKT VMLTGQVRAAAS, (SEQIDNO:8945); XM_014114526.1, KIAA0556, Del, G_7, GTGPTPGPARGLRTGSRG, (SEQIDNO:8946); XM_005636328.2, ACACB, Del, G_7, GTGSLRRCSSPT-MASLP, (SEQIDNO:8948); XM_546286.5, GRIA1, Del, G_7, GTIQVSRIGHISSLQS, (SEQIDNO:8949); XM_536612.5, PELP1, Del, G_7, GTKCQSPRRRLRQKTWR-PRWRQRRQPCRRRSRMTRLPCWLTSSIVPLMTT-SHHRPQ SLIP, (SEQIDNO:8950); XM_535893.4, RANBP9, Del, G_7, GTLGANKTPEFIARSLHASRST-FARLREGWSRQSQVAKTN, (SEQIDNO:8951); XM_014120234.1, GAREML, Ins, G_7, GTLPF-STWTPQGL, (SEQIDNO:8952); XM_014115372.1, DCST1, Del, G_7, GTPCLPGFFGKPLEP, (SEQIDNO:8953); XM_014121604.1, FRMD4B, Del, G_7, GTPFLEA-VGAPELLREARKMA, (SEQIDNO:8954); XM_014122053.1, FLNB, Ins, G_7, GTPHSKEPL, (SEQIDNO:8955); XM_005630224.2, KIF3C, Del, G_7, GTPRPSWWPLWGQLLTATTRASPPCALPTGPRTSRT-SPG, (SEQIDNO:8957); XM_014119249.1, CSMD2, Del, G_7, GTPSARSKEASTVPAIPAASRAAATASSWP-SAATPP, (SEQIDNO:8958); XM_005620393.2, MIB2, Del, G_7, GTQGPCSCCPGSRPQASRAAGS, (SEQIDNO:8960); XM_005622264.1, LOC100855804, Del, G_7, GTRAGKDRKEPQGQCGAVGPARREL-GTAVGQVVLGPGRIPERELLAPR, (SEQIDNO:8961); XM_014107317.1, NKX2-2, Del, G_7, GTRARSGSGGCSSPRHRPTSWSGASGSSGTCRRP-SASTWPASSASRPRRSRSGSRTTA TR, (SEQIDNO:8962); XM_005626996.1, KLF4, Del, G_7, GTRAWR-RAAAV AAAAAAAASSTAGSPCPLPRPPSTWRTSTT, (SEQIDNO:8963); XM_014107265.1, HELZ2, Del, G_7, GTRCRCSSVPPCSVASWHRVCSCARWHPASP-SAWSTWSGW AAASWTRCPRPCETAVPTWPST-PACGGPSAPWSRPPAPSWRVTPSRCST, (SEQIDNO:8964); XM_003639777.3, SYDE1, Ins, G_7, GTRLPAAGPHLPPRTRGGPAAAGTGAGVGPG-CAEAPALRPGHCAPTHSLPRVPGPA TGRASGAP-GAVVCQADAVRAAGSPRHR, (SEQIDNO:8965); XM_014120910.1, RTN4RL2, Del, G_7, GTRPRRTTTG-GATAARTSAASRRARARPARRPRTPAAPRSRPGCPAL-CSASCSWRPT TS, (SEQIDNO:8966); XM_546031.5, MBLAC2, Del, G_7, GTRRAGPCWPWPPTCTSTTP-GASTSSTGWRCITPRPRRWLAGTTLRR, (SEQIDNO:8967); XM_005641667.2, LOC102152628, Del, G_7, GTRRQRTQPFSLSLRRHLLMPCGQQQVPLSPLLRM-HPWQPMRR, (SEQIDNO:8968); XM_548847.4, STS, Ins, G_7, GTRRRPGARLPCCIAHVHGAHAREPWADVP-SCQRV, (SEQIDNO:8969); XM_005631505.2, CI8HIlorf85, Del, G_7, GTRRR-SWRSSQPGPASVTCVAFRAT, (SEQIDNO:8970); XM_014114474.1, LOC106558921, Ins, G_7, GTRSSRLCPGPKGQPASREAGPLPALVHGDHRA1, (SEQIDNO:8971); XM_540364.3, INHBA, Del, G_7, GTRTRSSPTDLSSCCRPASLKTTLIGGGGGAWSVTAR-STSAVRNSSL, (SEQIDNO:8972); NM_001197119.1, TMEM132C, Del, G_7, GTSCRTSPWT-SPTSRRRWSCPGRGAAWGPATWCRRPGA, (SEQIDNO:8973); XM_014116594.1, DMWD, Del, G_7, GTSPAAPPPAAGWTQPRCWALRCAHASTRCHCSSPS-CARRSPRSASRSSSSWRTASS PPARRASSVPGPGRAR-RASPPNQATPRVAQWC, (SEQIDNO:8974); XM_005632383.2, KCTD6, Del, G_7, GTSPQLETLKAIT-SLIEMDLFSDMFSTS, (SEQIDNO:8975); XM_005623126.2, LIPG, Del, G_7, GTSSQAVDSMMCWAQSHMEQSRRW, (SEQIDNO:8976); XM_005620290.1, LOC489267, Del, G_7, GTSSRSSGAPSTTSECPGRTGGTACGS, (SEQIDNO:8977); XM_543329.4, ANO7, Ins, G_7, GTTRCGPGRRPVVLPTRQGTRVPRRRPGLSSPSGH-SGLGARV, (SEQIDNO:8978); XM_843610.4, DPP7, Del, G_7, GTTSEVPATSSSPTGTWTPGQGVGSGVT, (SEQIDNO:8979); XM_853562.3, R3HDM2, Del, G_7, GTTVGLLRTAATRTSLPCTPSWLCFPAPWLPRMPP-FASTTL, (SEQIDNO:8980); XM_853836.4, TCERG1, Del, G_7, GTVSDSTRGSSGWLNSRP, (SEQIDNO:8981); XM_005634486.1, A4GNT, Ins, G_7, GTWEAGSR, (SEQIDNO:8982); XM_846693.4, GINS2, Del, G_7, GTWGLLTLVYQWKCLCGWRLT, (SEQIDNO:8983); XM_546596.5, FXR2, Del, G_7, GTWSRDCPSR-CAAPTGPSTRAL, (SEQIDNO:8985); XM_005636092.2, TMEM132D, Del, G_7, GVAAARSSTSMPWCGS, (SEQIDNO:8987); XM_847066.4, PAXBP1, Ins, G_7, GVAAGPGAAAAFRADPGLGGRGRGLLPGRRGAR-QRAEAAQEAAGEQRGAAGQPA ELPGRGGRK, (SEQIDNO:8988); XM_005629462.2, NOS3, Del, G-7, GVALLTGPGSCPPSLAASPLFSIRRWSTMSCPRP- SAIRQTRGRGVHPRVPASPGRKPL RKWPMR, (SEQ ID NO:8989); XM_003435632.3, MORF4L2, Del, G_7, GVALQRTPLQDQ, (SEQ ID NO:8990); XM_014109104.1, PAX2, Ins, G_7, GVCERPAPARRGEAAHRGAGPPGRAALRHIPAAARQPRLCQQNPGQVL, (SEQ ID NO:8991); XM_014114716.1, UNK1, Del, G_7, GVCGSVARTGSRLVLPGDGRLRRREPGRWVLH, (SEQ ID NO:8992); XM_014118709.1, PTP4A3, Del, G_7, GVEAVAQRSFPPEGQSRQGQGLLRLSKTQPREWFFCFLAVWLGRVTQPL, (SEQ ID NO:8993); NM_001003264.1, SRP72, Ins, G_7, GVGACALE, (SEQ ID NO:8994); XM_014120700.1, MTMR11, Del, G_7, GVGARVSTSPPRRWSQTWGSLDQSPSRGLGCWSPGVVSLAVTWLRDASQGSRS, (SEQ ID NO: 8995); XM_014111649.1, LOC106558441, Del, G_7, GVGGAVQAPTGMLQPRPVAWLPRFPVLIAEL, (SEQ ID NO:8996); XM_014113230.1, STX8, Del, G_7, GVGGRTLPRAPQPRLPQGRPRRRAGWSPGSGGRGGAVRRPGRCPEPCIGSHRTAGIS RPARIRAGGCGLPRTPPDSPGLPGQVQAE, (SEQ ID NO: 8997); XM_014121616.1, IL17RE, Del, G_7, GVGSTSWCRNTKSHISSGSVGDTRCQHMLRGS, (SEQ ID NO: 8999); XM_014121618.1, IL17RE, Del, G_7, GVGSTSWCRNTKSHISSGSVGDTRCQHMLRHLSQGAAL, (SEQ ID NO:9000); XM_005637591.2, UBTD1, Del, G_7, GVLAGKGWERGLTTAWL, (SEQ ID NO:9001); XM_003639260.3, MYO1C, Del, G_7, GVLCVTGCCRATLCWRPLEMPRPSGMITPAGLGSTWMYSLTSRVLPWVATSSVTSW KSPEWCTRTTGRETSTSSTSCWKGARRRCCAGWA, (SEQ ID NO:9002); XM_005640836.2, MIA3, Ins, G_7, GVLPTSHG, (SEQ ID NO:9003); XM_005636016.2, NOS1, Del, G_7, GVLRSRAASSRPATSSSQSTASPWWT, (SEQ ID NO:9004); XM_005620597.2, NOL9, Del, G_7, GVLSFFQGGRKVRTRSARNLAGRGPWYRVLLLAGSAV, (SEQ ID NO:9005); XM_003639746.2, STAB1, Ins, G_7, GVPARHMCPRLQRPLL, (SEQ ID NO:9006); XM_548997.5, PPP1R3F, Ins, G_7, GVPQPSPGHTHGPRPDLEVAWP, (SEQ ID NO:9008); NM_001253744.1, KRT15, Del, G_7, GVPSGLGEAALVGGVSTGVVEAAVFQLLLLDLFPRGQEGAMGVA, (SEQ ID NO:9009); XM_005618879.1, PRF1, Del, G_7, GVPSSACPWH, (SEQ ID NO:9010); XM_846580.3, LCAT, Del, G_7, GVPSSPCWSWPQVTTRASRSCPASS, (SEQ ID NO:9011); XM_005621273.2, FBRS, Del, G_7, GVPVGPLGSQGTALIGSLAGPLGIGPENGPISGEGKRPPPVILWKLDTYVMQKAIWM RGSPMMTSTHPLLSQPAKPRAPTAPSMGTVKQNSP, (SEQ ID NO:9012); XM_005630554.2, TET3, Del, G_7, GVPWLLSPSIRKRRGLSPLGRRWPCPQTQQSPCPPTPTRRSLAPTAAGS, (SEQ ID NO:9013); XM_005625810.2, FAM109B, Del, G_7, GVQGLRRPPVALAEGAGLSSKATCCSPLRVGRAGPR, (SEQ ID NO:9014); NM_001284496.2, TAP1, Del, G_7, GVQGTRSAGF, (SEQ ID NO:9015); XM_005640052.2, JARID2, Ins, G_7, GVQVHRARRQWPQGQWQVEPKVMH, (SEQ ID NO:9016); XM_542952.5, HCK, Del, G_7, GVRAAKIRAARRRRSGRPGWGV, (SEQ ID NO:9017); XM_014116004.1, GALNT16, Del, G_7, GVRILSSPSGCGCAVGAWRSCPAAGWATSSGNGTPTTSLRAMPSPISGIPSALQRCG WMNTSSITTRPGPQPSGRPLAAWPRGLSRGRR, (SEQ ID NO:9018); XM_843907.4, GPR37L1, Del, G_7, GVRPRTQAGTGLRPRGSRAGPEEALRTRRPRGCSSMCPRTGPSTPGPSTRLTCSPPSP, (SEQ ID NO:9020); XM_014115077.1, LOC611716, Del, G_7, GVSGPREGGWAQVGVGWTHRQASVSPKGPCRRMQSMSSACRNQ, (SEQ ID NO: 9021); XM_014111404.1, FRMPD3, Ins, G_7, GVSGSTQLSEADAPLQYQRTGSG, (SEQ ID NO:9023); XM_548354.4, RNF208, Del, G_7, GVSRRAAATRPSGSTVGPRAPAMCGTRCLPAPSC, (SEQ ID NO:9024); XM_542293.5, CAPN5, Del, G_7, GVSSAPPSRR, (SEQ ID NO:9025); XM_014116730.1, ARHGAP33, Del, G_7, GVSTTEGPCTGMGGKEGRGLVPHPPTPLPAGPSTLRVRPGATA, (SEQ ID NO:9026); XM_847645.3, TMEM38A, Del, G_7, GVTITMTTMAGPMVAVGPARHTQPCLLSPKRS, (SEQ ID NO:9027); XM_014119248.1, DLGAP3, Del, G_7, GVTPLGARTGRFPAAGCGAAATSKPWGMRRAETQTAAPRRLPKPWPGASPPAAPPV WTRPGSTAVSRPGSIPGAPSLATAVPSPPDSSVRS, (SEQ ID NO: 9028); XM_005631208.2, TNKS IBP1, Del, G_7, GVTSALASSPSPRPPSARASEIGAVTSARRLPREATSLASSVTTGQVVLP, (SEQ ID NO:9030); XM_005635711.2, CCAR2, Ins, G_7, GVVSLFGWPRPQGRPAGASPHCHSLCASPDWH, (SEQ ID NO:9031); XM_014121211.1, TRMT112, Ins, G_7, GVVSPPAQSEGRDARR, (SEQ ID NO:9032); XM_545865.4, CRTC3, Del, G_7, GVWGAGPRAGAGRRAAVGERRAAARGRPEGEGEASRAPGGNHKQLAGGRRGF SFSAHPPPAAGARRGRGEPGAP, (SEQ ID NO:9033); XM_014118297.1, MDC1, Del, G_7, GVWPAQWQRLPTW, (SEQ ID NO: 9034); XM_536512.5, PDZD2, Ins, G_7, GVWRRLGALLPRGGGGQPRDGHRQTPQGAGCRRASDRGPGGSRGTFSGPTSSGRW KRKFPPRGARHGQPDARPEEGLGSCWPAPPATVGLPAFSFRFH, (SEQ ID NO:9035); XM_005616718.2, LSR, Del, G-7, GWAPGRPLGAGARSSSGASFSAPCAQPLPVPSR, (SEQ ID NO:9036); NM_001346058.1, KRT23, Ins, G_7, GWGCPHLPFLQLTKVSASWRALGI, (SEQ ID NO:9039); XM_005634337.2, EOMES, Del, G_7, GWGFLVPASVPTSTCATGLCGSNSTATKPR, (SEQ ID NO:9040); XM_014111649.1, LOC106558441, Ins, G_7, GWGGLCRRPRGCSSPGPWPGSRGSLC, (SEQ ID NO:9041); XM_014113212.1, LOC106558751, Del, G_7, GWGGTRLN, (SEQ ID NO:9042); XM_014112782.1, LOC106558678, Ins, G_7, GWGQLSAPRPPGHPRASPQSPVPALHGLPGTHPRPGAAVRGGTLCLPGSSGSRGGLD AAQAPTSRGWSLICGCPRLASSRNSARRPGARTNG, (SEQ ID NO:9043); XM_014122630.1, FAM160A2, Ins, G_7, GWLRTPARASTTS, (SEQ ID NO:9045); NM_001145174.1, CA9, Del, G_7, GWPCWPPFCRRVQKKTVPMSSCCHIWKKSLKKTQRLGSQDWMYPRCCPLTSAATS AMRGL, (SEQ ID NO:9046); XM_862887.2, PRR23A, Del, G-7, GWPGRARARGPPALVQRGSLLSATSTWTPTSWSPSPARHSSLCRPLRVRVPTCAPSA LQDPPPRPGDACSRN, (SEQ ID NO:9047); XM_862898.3, LOC611145, Del, G_7, GWPGRARGPPALVQRGSLLSATSTWTPTSWSPSPARHSSLCRPLRVRVPTCAPSALQ DPPPRPGDACSRN, (SEQ ID NO: 9048); XM_845621.5, MLLT6, Del, G_7, GWRAAGPCPSMGSWGG, (SEQ ID NO:9049); XM_005619991.2, EFNB3, Del, G_7, GWRCSCWAWQGLGVPCVGGDGGPSLRRVATLVLAPSGGEGLWAWAAEVAWGLG RLSLGS, (SEQ ID NO: 9050); XM_014122483.1, LOC106560169, Del, G_7, GWRGGAVERLDVAWTPSWAGRRPPASFPSYPRARSA, (SEQ ID NO:9051); XM_005617934.2, PAX7, Del, G_7, GWRRPPQPRTPAQPTEPATASPATRTAS, (SEQ ID NO:9052); XM_005621026.2, SLC12A9, Ins, G_7, GWSLLHDQPDPGA, (SEQ ID NO:9053); XM_538325.3, TRMU, Del, G_7, GWTAQWPRCC, (SEQIDNO:9054); XM_005623069.1, LRRC30, Del, G_7, GWTCSSVT, (SEQIDNO:9056); XM_005638641.2, CSPG4, Del, G_7, GWTQRPPATSRNTAWAWPRGPSTSPSWAAWRISASTARGRGSGKPR, (SEQIDNO:9057); XM_014111291.1, CD84, Del, G_7, GWVFYRSSLPGRSQ, (SEQIDNO:9058); XM_005624167.2, OTOP3, Del, G_7, GWWSSIWRP, (SEQIDNO:9059); XM_014117140.1, IKZF4, Del, G_7, GWYPSLRAPRPSHLPPLWWAGPALPTPKRTPSRRRGYCGAPQAPPRKCSGWWARV VSP, (SEQIDNO:9060); XM_534537.4, LATS2, Ins, G_7, GYDEPADPDGGIP, (SEQIDNO:9061); NM_001287152.1, PIGR, Ins, G_7, GYGAVRGQARTA, (SEQIDNO:9062); XM_005627200.2, ZBTB22, Ins, G_7, GYLWEAAAGGR, (SEQIDNO:9063); XM_548318.5, HIC1, Del, G_7, GYPASPAPTARASSTSPRASLLWPDSRQNS, (SEQIDNO:9064); XM_005624150.1, CBX4, Ins, G_7, VAVGDRVRPAAAPPPLPTCTATELSLPKTE, (SEQIDNO:9066); XM_014112641.1, NWD2, Ins, G_7, VCEVPSNLGHGSRNGHGRQ, (SEQIDNO:9067); XM_005633560.2, ART1, Ins, G_7, VCICIPAERRSPAVWGGYLLRHLDLPWGTYQGLFLLPRGGGGADPPLRDLPGDQCQ, (SEQIDNO:9068); XM_547872.5, EXD2, Ins, G_7, VCPMERHPAAAEE, (SEQIDNO:9069); XM_845621.5, MLLT6, Ins, G_7, VEWGCRPQPCGLEPGWRGPHAAAARLS, (SEQIDNO:9070); XM_005618685.2, GAK, Ins, G_7, VGGLGRGAGPRSCCRRRPACRPQCPRELDQVSEPGPVC, (SEQIDNO:9071); XM_005618689.2, GAK, Ins, G_7, VGGLGRGAGPRSCCRRSLLLCRRPACRPQCPRELDQVSEPGPVC, (SEQIDNO:9072); XM_005623276.2, NFATC4, Ins, G_7, VGGRTGLRGRPAMLPSGPGGAPSLWRCPYWHSPASTPSAWHAFATTPPGPLTWHLG EPACPVSEAGGAGRGFRGGGGRPCSRMPQHPHHLHLSHA, (SEQIDNO:9073); XM_014114294.1, TECPR1, Ins, G_7, VGNHRRARGPPVRMGCVSAGQGVVQRGRQPPQPRRLIVVPHGHPRGGGADQLWAP RPPVGHALGGAGLGPGRNQQEQSQRKFLVHSGASHL, (SEQIDNO:9075); XM_014121983.1, ADGRL1, Ins, G_7, VGRGPPPF, (SEQIDNO:9076); XM_843208.4, SPATA24, Ins, G_7, VGVGVSRLRSTAGRDRISGGTDPAAEERDGSPGRKFCQ, (SEQIDNO:9077); XM_005634338.2, EOMES, Ins, G_7, VLCFLHNSL, (SEQIDNO:9078); XM_843185.4, ATP12A, Ins, G_7, VLHPSVDRSHPVLDCVWDPVLHE, (SEQIDNO:9079); XM_014120548.1, GRHL1, Ins, G_7, VLQTHSHRDL, (SEQIDNO:9081); XM_005624466.2, KCNH4, Ins, G_7, VPLPPPPLQRPQGRVGRPHPPCHLLRCGHRPLQCLLLGR, (SEQIDNO:9082); XM_003639890.1, LOC100856687, Ins, G_7, VPPAAETHLLCRLHDPAVLLQLPGVHRMRAPGLHGLRPLRGHLPPPALPSHHDHGA LRPAGGLLLRQRLLHLYDQGVLCLQGHVLWLQRPEPLLL, (SEQIDNO:9083); XM_014116198.1, RAC3, Ins, G_7, VPRAPSPQGRDSVA, (SEQIDNO:9084); XM_014122205.1, LOC106560134, Ins, G_7, VQCLSLLLCGNQEAGPGQSSCGLSPVSLGNS, (SEQIDNO:9085); XM_014121155.1, CD6, Ins, G_7, VQMDACRRTESAGQVCVRVFTSGCHSPKNLLRSPDSSPI, (SEQIDNO:9086); XM_541287.5, TMEM2, Ins, G_7, VQPRDVRGWPFYSSQLLTVHHRAWDKWPAD, (SEQIDNO:9087); XM_005628594.2, HDAC9, Ins, G_7, VQSDSKMLWSFDEAIDDIG, (SEQIDNO:9088); XM_531653.5, XRCC6BP1, Ins, G_7, VRARAPLQRLLQRPGVPAAAPEDAGDKSLCQTSA, (SEQIDNO:9089); XM_014111629.1, ARHGAP6, Ins, G_7, VRGLPSGVPRVQHAPHPGRQKVGAGRTQGRAVLDSEQRRRPHRE, (SEQIDNO:9090); XM_545627.5, CPS1, Ins, G_7, VRLRNLSH, (SEQIDNO:9091); NM_001103215.1, COL6A3, Ins, G_7, VRPEHWLGPELCPCQPLHRSWRQQDPRTRAAALAPAHSRAV, (SEQIDNO:9092); XM_014112406.1, NMBR, Ins, G_7, VRPGLSARLGRDRRQVRHPLRDPVPLPAHHRRGLAGQHHAGEDLHHHQRHEERPQ HLHL, (SEQIDNO:9093); XM_014109896.1, LOC106558120, Ins, G_7, VRVGGRLPAPRAALRRSWLPHLPGWRPIADQGATGKRKEQPYLWTPSPEEEKGSAC KFKG, (SEQIDNO:9094); XM_005633207.1, SAMD1, Ins, G_7, VSLCCHWARLPIPCAFAPRKTSPARG, (SEQIDNO:9096); XM_014116695.1, BZRAP1, Ins, G_7, VTGHERQGVGSPLQGKATPKETGLWEKGV, (SEQIDNO:9097); XM_540709.1, OR14DL1, Ins, G_7, VYPCSNTASLHVSTTLLWPQCY, (SEQIDNO:9099); XM_005641605.2, TCEA14, Ins, G_7, VYVDAKKFTGPLPPEGPKGTEGWVQGPTEGL, (SEQIDNO:9100); XM_005615822.1, RASEF, Ins, G_8, AAASRGSPPARARARARARLSVGGARPRRRRGRGRGRGRGRRGRAGGRLGSG EPRPGLAGLPGATRRRGQIHPQKRTS, (SEQIDNO:9101); XM_844530.4, GAS6, Ins, G_8, AALRQRCQRVWPAERGLQPHLFQQAGQLPLCLLQRLRALP, (SEQIDNO:9102); XM_005620318.2, PLSCR3, Ins, G_8, AAPRSPHRCR, (SEQIDNO:9103); XM_014111383.1, RBM10, Ins, G_8, AGAQAQPHWPPRFPPRRGLSGPGLSAPPMGGSGPF, (SEQIDNO:9104); XM_005638688.1, MYO5A, Ins, G_8, AGARAGVGPLVPWSPAVRYLRATPRALFGSMPPASAGRASCFRIAFEGSVLSLLYRR QYF, (SEQIDNO:9105); XM_005642352.1, LOC102157319, Ins, G_8, AGFCRGSHSCRAQPRT1, (SEQIDNO:9106); XM_014116572.1, LOC106559285, Ins, G_8, AGGERDPRSQTPDALAAGEGASCALDARARRGGPVAGREEAPRAGAKGGPCRPAT APGRAPGTRAPT, (SEQIDNO:9107); XM_005616888.2, CAPN12, Ins, G_8, AHPQVHCPSVTHPAQPAAPEGPGPHLPHRGLPCVPAAGGRTAGIREVAAGPWGGAH RDCLGSEVACPRLPPEQPADPGPH, (SEQIDNO:9108); XM_014117109.1, ESYT1, Ins, G_8, AHTRPLLGAAAAAAPATRGQAPGRPGRAPGPGGPGAADRVVPR, (SEQIDNO:9109); XM_546961.5, GAL3ST4, Ins, G_8, ALPEEATRPAAPTALGPIPEIGCIILPTPAATCVPEDS, (SEQIDNO:9110); XM_858955.4, GLYR1, Ins, G_8, ALSGSPSLRESAAV, (SEQIDNO:9111); XM_003639258.3, DOC2B, Ins, G_8, APPQPPGGKPGPRGLKFRRLQKLYCPGHAGFQPALRPGKQRPPLYHQQGQGPEADG PQRASRPLCQAASAARSQ, (SEQIDNO:9112); XM_859724.4, NRAP, Ins, G_8, ARGCGARRESEGGREPRRHRDSARQKEEGSAVV, (SEQIDNO:9113); XM_005630524.2, PCGF1, Ins, G_8, DAGARSGD, (SEQIDNO:9114); XM_005619129.2, GPRIN2, Ins, G_8, DVPVQVPQGAPRALPLLCPPLGSRRVRHGACCQDQGRVDHDFGQ, (SEQIDNO:9116); XM_005628195.2, PDGFRA, Ins, G_8, EPKPARGPKVFRNYGDFPSGTPDLRLSPRRAQPNPLPAFITLDPSK, (SEQIDNO:9117); XM_014120653.1, PRKAB2, Ins, G_8, ERHGAKVFSCRGCRRPRPFKGAQDHGGEYGRPQRLQPAGPQAPWGQRVCIMATGF GGLRKAHTAGSAHCYPMV, (SEQIDNO:9118); XM_014107586.1, GALNTL6, Ins, G_8, ESNCAFVLQMPNS1, (SEQIDNO:9119); XM_538860.5, RGL2, Del, G_8, GAALTSSATSGSGWTPRPPTFLSPWPSPAIPLLTPRMSWCSSLTTWPNS, (SEQIDNO:9120); XM_014117556.1, LOC102156852, Del, G_8, GAEEAAARRAAGPERRCNPSRGPRPLPAGPS, (SEQIDNO:

9121); XM_0141 19807.1, ATG9B, Del, G_8, GAEGGQGGGETWGQVPCLSSPYPCLLFLLLLVGGLAEGGFPSSLCPLPPTQEAPLPL WPWDHPAQRCRPRGPLTLATAPSPPGQHRHSL, (SEQIDNO:9122); XM_858955.4, GLYR1, Del, G_8, GAFWKPQSQGISSCLMMGCW, (SEQIDNO:9123); XM_014115679.1, NPAS3, Del, G_8, GAGAGARGARAAGAAAGARARARAAAPARPTPCCTLGTWRRCRGCRRATSCSRW CTG, (SEQIDNO:9124); XM_014112777.1, LOC102154969, Del, G_8, GAGAHGRSGAPALGARAEGEEAAAAAAEVEAASWKGDRVQDGVESWRFPGLRWK LERCFYLQALRMRS, (SEQIDNO:9125); XM_547168.3, CLDN6, Del, G_8, GAGAQVIIWPDTQHLPHMPPLRVPPSTPLRIMS, (SEQIDNO:9126); XM_005619129.2, GPRIN2, Del, G_8, GAGGGARFEPSCSPCGALAAAAAPAPPPS, (SEQIDNO:9127); XM_005625650.2, NXPH4, Ins, G_8, GAGGGRAGRPLRGRAGSAGGQGVPRLQLPRGV, (SEQIDNO:9128); XM_014114294.1, TECPR1, Del, G_8, GAGITSLSGPMPPEPSGAGPRRQPLTGVGSRASPARRRGWLEPRRRPVALSAA, (SEQIDNO:9129); XM_005628806.2, CPED1, Del, G_8, GAGLCRSLSTLRELSPRARPLVLRRTGCVAPGPPGLSPWPAGLPWAAPGRRP, (SEQIDNO:9130); XM_539064.5, LIN28B, Ins, G_8, GAGLHLTALPPGGQVRGLRMAGQVIPRRFLSKGICSAGGTKQKGAFCSKKEKDL, (SEQIDNO:9131); XM_005615669.2, TNFRSF11A, Del, G_8, GAGNPSWLPRKVDLCPSAPTAWAFRPRVQQMGPASPWTGLTSGFPAP, (SEQIDNO:9132); XM_848851.3, FAMIO1B, Del, G_8, GAGSARRPPGRWSPTRRRAPRPRIQHLSPAHWPLPAHQGCALCPLVKEWSLIPYRQR K, (SEQIDNO:9133); XM_014118915.1, CTTNBP2, Del, G_8, GAGTRGAALPPRRGAQLPAGGGPRGSPQPGRGGEGRGGGATGQRPGERGCRVPLA KLASLHRKLSGKIDFSFFARKTKKSLMWTPSVNQSSGCSSA, (SEQIDNO:9135); XM_005628195.2, PDGFRA, Del, G_8, GAKACSGTESFPELWGLPFWHS, (SEQIDNO:9136); XM_005619219.2, KCNIP1, Del, G_8, GAKKKHSNKTTPRFSPMEMPACMPITSSTPSTPPRQAP, (SEQIDNO:9137); XM_536395.5, VCL, Del, G_8, GAKPNFALRRKSQNHIRVLLSLPCP, (SEQIDNO:9138); XM_014144471., METRN, Del, G_8, GALAPSSSWAGATLGRPGWAVHLTSRSSAEPTQLPTPAASTSARWPWT, (SEQIDNO:9139); XM_005632929.2, ARHGEF18, Del, G_8, GALCPPPPCHCPPPRSARKKAARKTSSSS, (SEQIDNO:9140); XM_014106895.1, LOC100683453, Del, G_8, GALGTWHWTRHAARAPSDPGNTPWGSPSPGIRRAGPRGGPPQSRPGGAHPRAAPTA HGPQPWARTVPGTRGSQKPLGQWRPD, (SEQIDNO:9141); XM_532350.5, GPAA1, Del, G_8, GALNLVLLSSQHRVWGWPRLWRLC, (SEQIDNO:9142); XM_548255.6, TAF15, Del, G_8, GAMEETAVVAGATVETEVAATEETEVGAAMEETEEAMEAKWEEETTTEMISATDH T, (SEQIDNO:9143); XM_542166.4, ZBTB7A, Del, G_8, GAMGAPGPPPRAASRPDLP, (SEQIDNO:9144); XM_005628310.2, OPLAH, Del, G_8, GAPASSSGLASLWWGLSPQEPILAPPATARGAP, (SEQIDNO:9145); NM_001131049.1, DNM1, Ins, G_8, GAPRALQAGGFP, (SEQIDNO:9146); XM_014116623.1, HOXB2, Del, G_8, GAPRARPRGWSPSRCRKMPSRSARILLSCPTSTSSRSTPVSSCPEASPPACRARSTARF PFPRKSWTSSPAPSVPSTCSSL, (SEQIDNO:9147); XM_845159.3, PBX2, Del, G_8, GAQPQLLQLLQPPGAACPLTTPLSTPTTAANLPRSATSTTQSWRSMSRPVTSSRPTS, (SEQIDNO:9148); XM_014114946.1, PTPN7, Del, G_8, GAREHGRPPGLWGEP, (SEQIDNO:9149); XM_535406.5, FBXO2, Del, G_8, GARGGASVPSLPLLGCAPRTPRPTQTRGPSPPPAAPLERAPRSDPPSR, (SEQIDNO:9150); XM_014117986.1, LOC106559521, Del, G_8, GARKPRPEPRELANSWRGLGHPRPPQSHL, (SEQIDNO:9151); XM_532334.4, KCNQ3, Del, G_8, GARRRRATRSAKWGWRRATRSKSPWRSGPGRTKTGPCCWRAAAATRGCGGPRRA SGSWPRPP, (SEQIDNO:9153); XM_543651.3, KRT82, Del, G_8, GASEPWAAWAPGACATWASGGPGWPPGAACLASGTEWGPSPDPRPASPPSPSTRAC WSHSSWR STRLCRG, (SEQIDNO:9154); XM_005618715.2, MYL5, Del, G_8, GASGPRGHPPTSFPTLSRPRSRSSRRRSR, (SEQIDNO:9155); XM_005616888.2, CAPN12, Del, G_8, GASPSALSFCHSSSATGGA, (SEQIDNO:9156); XM_531943.5, ADAMTS1L, Del, G_8, GASRAGQFPVWRRTSRGMSPQWKSGNACTPLRCPSCSPATFLTVLNGWHRSGLRAR (SEQIDNO:9157); XM_005628310.2, OPLAH, Del, G_8, GATGTQRTPCHHRGRPSTSPPSLSGAASTSTAGPRRPC, (SEQIDNO:9158); XM_005626996.1, KLF4, Del, G_8, GAVLFLSQVRNPTTVIGTAVGGNSPARTN, (SEQIDNO:9159); XM_014111649.1, LOC106558441, Del, G_8, GAVQAPTGMLQPRPVAWLPRFPVLIAEL, (SEQIDNO:9160); XM_014111170.1, PLEKHM2, Ins, G_8, GAVRWLSEGQHHGSAPRLPGHPRRPAVPGAERRERG, (SEQIDNO:9161); XM_005616263.1, LRRC4B, Del, G_8, GAWAGTVTWPCPPWSATISTITITWRPPSRRTIAATPAAGAAGARAPRGSTPSTNLCS SRVAPRRMCKRRRS, (SEQIDNO:9162); XM_846128.4, HOXB7, Del, G_8, GAWRARVQPASTRPATGSSRVPSTCTARPLSRTSPGCVPATPPRRRAPRSRGTRTWR PRVTSGSTPGCEAQGRTESEAARPTPATRPWSWRRSFTTIAT, (SEQIDNO:9163); XM_014114365.1, SETD1A, Del, G_8, GCPCPSRCKPRC, (SEQIDNO:9165); XM 014114498.1, C6H16orf92, Del, G_8, GCPQLPVPSSFSLPSLQSCAQNGSRL, (SEQIDNO:9166); XM_539064.5, LIN28B, Del, G_8, GCRAAPHRPSPRRPGSRSQNGRAGHPKTLPQQGHLQCRRNQAKRGL1FKKGKRP, (SEQIDNO:9167); XM_005620318.2, PLSCR3, Del, G_8, GCSKKPSQMQMTSACSSLWIWT, (SEQIDNO:9168); XM_547555.4, EFNA4, Ins, G_8, GCSQPPLSLAALAAPNSASPASSL, (SEQIDNO:9169); XM_014112314.1, ACAN, Ins, G_8, GCVPLPPRLRPL1TD1, (SEQIDNO:9170); XM_014119028.1, NRF1, Del, G_8, GDRSSCLGKPQQLSEHLLESKMLMDWSRSL, (SEQIDNO:9173); XM_014119037.1, NRF1, Del, G_8, GDRSSCLGKPQQLSEHLLESKMLMVPTSF, (SEQIDNO:9174); XM_014110056.1, LOC102151348, Del, G_8, GEEGEMAQNVGTLSPSRRAAGTPPGMRRLTTSPPTRSS, (SEQIDNO:9175); NM_001003009.2, TPO, Del, G_8, GEHSPSWASRCWWPSRAASSPSSSEAGTSCGDRAERPVSLAS WRRAGAWWTAPSST P, (SEQIDNO:9177); XM_538859.5, WDR46, Del, G_8, GEISGKRPPGKMTKSGRALSNSHRSKRRKPSP, (SEQIDNO:9178); XM_854614.4, MBD6, Del, G_8, GELRHPSRRLLVP, (SEQIDNO:9179); XM_005629758.2, PSD3, Del, G_8, GEMMISLGMGMQRTPLMCTAPSLKLFW TTLRYTT TVLNPWRHYIQNPIAILALTCPSL R, (SEQIDNO:9180); XM_005629149.1, TPPP2, Ins, G_8, GEPADRHQQVHGQPQGAFRREWQGQRHRRPGRGDRQLRLCNAPPDGEQEKHCHV SEERNAA, (SEQIDNO:9182); NM_001284460.1, HTRA2, Del, G_8, GFTRGRDPC, (SEQIDNO:9184); XM_005626238.1, EPCAM, Ins, G_8, GGAGAEGP- PRGVGGRPPPPHLLPPGAGRWPRMCASRGHRWLRG-GRAARTCAGAGP GPQRLARCPLVMYL, (SEQIDNO: 9185); XM_014118903.1, LOC102156909, Ins, G_8, GGGAARPGSLTVTRGAAPSGAAPARRGPRTVSR-GRRSRPLGLERQACRRPAAADTG RGRGGQRTA-SAEAGRCCNLRPRLRTAPS, (SEQIDNO:9187); XM_005641356.2, SHROOM4, Ins, G-8, GGG-GAATPVFQFRNHWYECPPSRRGPGAATILGLWSFGG-SKAGPAKLSGRARVL, (SEQIDNO:9188); XM_532250.5, QRS1L, Ins, G_8, GGGGEGDRTLSTP, (SEQIDNO:9189); XM_005626232.1, LOC102151375, Del, G_8, GGGGLKIAQQPGAEATAGANKR-GAQRPSLESDPCNTQEASGSARLAPAPGGRGKED SRARSRAPPPPHTPALSPSSGATTRAPP, (SEQIDNO: 9190); XM_014112752.1, TRIM67, Ins, G_8, GGGGWKRIGPLPPAFSLAV, (SEQIDNO:9191); XM_005638688.1, MYOSA, Del, G_8, GGGTGRGRSPG-PLVPGSSLPACNP, (SEQIDNO:9194); XM_014111383.1, RBM10, Del, G_8, GGGTGTAPLAPQVS-PETGTFGTGTFGPTNGRIWPFLRRRRRRRSPVTSSC, (SEQIDNO:9195); XM_014106932.1, LOC106557687, Ins, G_8, GGNKQTSPWT, (SEQIDNO:9196); XM_005627459.2, C12H6orf141, Ins, G_8, GGR-GRRPGRLPRRLPRDPPGRRRAGL, (SEQIDNO:9197); XM_005615822.1, RASEF, Del, G_8, GGRQPGLPAGPR-PRPRPRPAQRRRRPTPKTAARTRARTRARARATGTR-GRPPGVGR APARPGGTSRSDSATRPNSS-PEKNKLAPCI, (SEQIDNO:9198); XM_014116572.1, LOC106559285, Del, G_8, GGRRKGSALPDPGRPGRG-GRGV VRPGRARPTRGTSRRAGGSAQG-GRQRRSLPTCDG PGKGSGNAGSDLRASSKPQGPR, (SEQIDNO:9199); XM_014121384.1, MYO7B, Del, G_8, GGSNYPAQVVSPALLSPLTWLPGLWRTPGQAPS, (SEQIDNO:9201); XM_847261.3, FOXA1, Del, G_8, GGSWILGRELNSS, (SEQIDNO:9202); XM_005625313.2, DPM2, Ins, G_8, GGTLLSWDT, (SEQIDNO:9203); XM_014120933.1, LOC100687378, Del, G_8, GHCPLHTSLPTAGHCPPVPTAGSLPTAHL-AAPLDPWYKGSPQCA, (SEQIDNO:9205); XM_537262.4, DENND4B, Ins, G_8, GHGGGAAPPAG-GLLRDSRACRERSSHSRGDTGSRTQWAPAPSPAS-RAHHRHGGHCS GTGRGSAPGLHLHPVLRWGP-PLGTQCRALGWNAARHLLPQGP, (SEQIDNO:9206); XM_846128.4, HOXB7, Ins, G_8, GHGGPECSRRLR-GRLRARAEFLQHALRAL, (SEQIDNO:9207); XM_531943.5, ADAMTS1L, Ins, G_8, GHPEPGSFLCGGGHPGACHLSGRVEMHVHP, (SEQIDNO:9208); XM_014116616.1, TBKBP1, Ins, G_8, GHVLRLPLCPHHSLWGHQGAAGRPGKGECHPPTP-SQSLRDQVPTDQRLWRGARLLP V, (SEQIDNO:9209); XM_537179.5, PAPPA2, Del, G_8, GIALRMATIFVGT-WAHWSSGQLPFHKATSNTVLSIQLEWEN, (SEQIDNO:9210); XM_538859.5, WDR46, Ins, G_8, GKFLEKGPPVK, (SEQIDNO:9211); XM_005624024.1, CCDC40, Del, G_8, GKKWGPWILKSRG, (SEQIDNO:9212); XM_005629705.2, INSIGI, Del, G-8, GLAA-LAAAPRAAGTTTWCDGAWCCSRWGSCWPWCSTC-CRCSGTSRCSPRRSSPPSS RRPGGSRRAAGRRPLWWACCTPASTVTWENHTSL-RESGPA, (SEQIDNO:9213); XM_014111649.1, LOC106558441, Ins, G_8, GLCRR-PRGCSSPGPWPGSRGSLC, (SEQIDNO:9215); XM_014112314.1, ACAN, Del, G_8, GLCSTTAQAP-PATH, (SEQIDNO:9216); XM_005624124.2, CD300LF, Del, G_8, GLEGSRCGGCRAS, (SEQIDNO:9217); XM_014117986.1, LOC106559521, Ins, G_8, GLGN-RAPSRES, (SEQIDNO:9218); XM_014114294.1, TECPR1, Ins, G_8, GLGSHHCPGQCHQSLQEQVPGDSH, (SEQIDNO:9219); XM_014113657.1, SOGA3, Ins, G_8, GLLEGRM-PAV, (SEQIDNO:9221); XM_538741.5, SHB, Ins, G_8, GLLGRPHLEPDGLRWQETAQQVCRLGRGGER-GRQEGQGDHC, (SEQIDNO:9222); XM_005628310.2, OPLAH, Ins, G_8, GLPPLLQVWPLCGGA, (SEQIDNO:9223); NM_001284453.1, PSMB7, Ins, G_8, GLQGWHSS-WSRYKGN, (SEQIDNO:9224); XM_005628310.2, OPLAH, Ins, G_8, GLRGPRGPRATIGVAPAHPRLP, (SEQIDNO:9225); XM_014116869.1, CAMSAP1, Ins, G_8, GLRGRAAGVQGCRPPETAVGPSGGGWGLWGGG-NAA, (SEQIDNO:9226); XM_549094.4, FGF16, Ins, G_8, GLRLLGLGSARLLLVCGERAHS, (SEQIDNO:9227); XM_845159.3, PBX2, Ins, G_8, GLSRSCCSCCSLR-GRRVP, (SEQIDNO:9228); XM_014119359.1, CCDC9, Del, G_8, GLTLSGCAAAWSRSGRAAGPAWAALAT, (SEQIDNO:9229); XM_548255.6, TAF15, Ins, G_8, GLWRRPRWWRGLRWRPRWRLRRRQKWGRLWRR-PRRLWRQNGRKKRLQK, (SEQIDNO:9230); XM_545391.3, LOC488269, Del, G_8, GPAPPRRALRRP-PRRPRSPPRPQEPKRPKAPRRRKRPSPRRR-PRALRRPKL, (SEQIDNO:9232); XM_538741.5, SHB, Del, G_8, GPARAAAPGARRPAVARNCSTSVPPRPRR-RAGPARRTR, (SEQIDNO:9233); XM_005616622.2, SPRED3, Del, G_8, GPARGTTSSTGSAFGTRKPPWSVP, (SEQIDNO:9234); XM_014109368.1, LOC106558038, Ins, G_8, GPATPPPFGFGVCCFRCGIFTGGFWARLTEW-LRAPRCRQRRAFPLSSGCGRDRTRPR SPSR-ERPSWAAGARWVGPSWAHCSP, (SEQIDNO:9236); XM_005632929.2, ARHGEF18, Ins, G_8, GPCAPLPLA-TAHHPAQQGRKQQGRRHLLL, (SEQIDNO:9237); XM_005616205.2, LOC476396, Del, G_8, GPCRRMQSMSSECRNQ, (SEQIDNO:9238); XM_005619129.2, GPRIN2, Ins, G_8, GPEG-PASSRHAVPAAP, (SEQIDNO:9239); XM_547168.3, CLDN6, Ins, G_8, GPELKSLYGPILSICRTCH-LSVCPRVPH, (SEQIDNO:9240); XM_014111152.1, HHIPL2, Ins, G_8, GPEWLGPQAPC1, (SEQIDNO:9241); XM_005626996.1, KLF4, Ins, G_8, GPFSSSPR, (SEQIDNO:9242); XM_014120955.1, NRXN2, Del, G_8, GPGEEEPAMCTSQRKARRSLWRPSKAMSSSATTCRI-TRSRAARTRSLWPSAPCSATG, (SEQIDNO:9243); XM_014118248.1, LOC106559564, Del, G_8, GPGPA-PRALRAPPARGPSHLALKVSPSAACP-PRLWQLVPSSGVRPRAAPAAPSRTPP AARP, (SEQIDNO:9245); XM_014113209.1, ADAMTS8, Del, G_8, GPGPGAARGCAAASSRAPWTARPGRWRPSACAGA, (SEQIDNO:9246); XM_005615669.2, TNFRSF11A, Ins, G_8, GPGTPRGFPEKWT-SAPVRLRHGPSARGCSRWGRPAPGRG, (SEQIDNO:9249); XM_547055.4, TBC1D10B, Ins, G_8, GPLSTSS-CPQG, (SEQIDNO:9251); XM_005616622.2, SPRED3, Ins, G_8, GPPGALRHPRGAPSGPENHLGVYPEARL-GLQQSEPHFSSLEPG, (SEQIDNO:9252); XM_005618715.2, MYL5, Ins, G_8, GPPGPE-GILQRLFQL, (SEQIDNO:9253); XM_542234.5, MAML2, Del, G_8, GPPGRGSLEGARSPRGCTAPSWSACGLGLP-SAASTT, (SEQIDNO:9254); XM_844466.4, MAZ, Del, G_8, GPPPLSRETPPSHSPPV, (SEQIDNO:9255); XM_014118241.1, NOTCH4, Ins, G_8, GPPQTLCPWR-PLPEPISWTRDLPVCTWLPG, (SEQIDNO:9257); XM_014121544.1, TTL13, Ins, G_8, GPQTAAQQAGGL, (SEQIDNO:9259); XM_542234.5, MAML2, Ins, G_8, GPRGGAPWRGLGHPEGAQRHRGAPAGSDCHLPPAP-PELRRPL, (SEQIDNO:9260); XM_014109368.1, LOC106558038, Del, G_8, GPRHAAPLRVWGLLF, (SE- QIDNO:9261); XM_005616802.2, PLEKHF1, Del, G_8, GPSAGPPVGTTRTPTRTRRAEGTATGPATWSST-PRACPGQPFTA, (SEQIDNO:9262); XM_003638990.3, SYNPO2L, Del, G_8, GPSRGNLYRCPRSEDGAR-LAEQDSERGTSFWPSMGSPAPASPMPVP, (SEQIDNO: 9263); XM_546961.5, GAL3ST4, Del, G_8, GPSRR-GYQACSSDSPWPHP, (SEQIDNO:9264); XM_547737.5, JPH4, Del, G_8, GPVNRQRN, (SEQIDNO:9265); XM_014119783.1, SSPO, Ins, G_8, GPVPEEPQLLKP-PAQERGCPLCWGEAPVSALQPLAL, (SEQIDNO:9266); XM_005641468.2, ITGB1BP2, Del, G_8, GPVTTQN-SWRG, (SEQIDNO:9267); XM_537262.4, DENND4B, Del, G_8, GPWRRSGPPGWWITS, (SEQIDNO:9269); XM_005628806.2, CPED1, Ins, G_8, GQASVAR-SPHSGNCPHVQGPSCSGVPGVWRPDPLASPR-GRQVSRGPRRAAALSEAW S, (SEQIDNO:9270); XM_003639170.3, SLC27A3, Del, G_8, GQGPGGRPA-GALLATFDFLGRKGAGGGPAGKGRVPAHARSRGRG, (SEQIDNO:9271); XM_005621751.2, CAPN15, Ins, G_8, GQHEGGRRCL, (SEQIDNO:9272); XM_005625443.2, FUBP3, Ins, G_8, GQQSCPTPSSQGS, (SEQIDNO:9273); XM_859724.4, NRAP, Del, G_8, GQRLWSPQRIRGGT, (SEQIDNO:9274); XM_005619219.2, KCNIP1, Ins, G_8, GQRRNIQTKPRPGFPPWRCQHVCPLPL-PRLRHHPDRLREVRGLCNCSVNFTERNRP, (SEQIDNO:9275); XM_014106959.1, ADCY7, Ins, G_8, GQSKWPCSWHLCQP, (SEQIDNO:9276); XM_003638990.3, SYNPO2L, Ins, G_8, GRAEETFTGVQDPKTEPGWQSRT-PREGPAFGHQWGLLHQPLPCQCHEPHRCLRESA YPHSAAGRG, (SEQIDNO:9277); XM_014106932.1, LOC106557687, Del, G_8, GREQTNKPLDVIGH-GIRQSSQSPAHGLVRGRRGHLGRRCRRVSQGR-GRAGPRPPRA RPAGGRASGVRAPLRG-GAPRPPTAVRRPPGVRSGPGSLRDRLM, (SEQIDNO:9279); XM_014120955.1, NRXN2, Ins, G_8, GRERRSRRCAPANERQGGVCGDLQRQ, (SEQIDNO:9280); XM_005619419.2, GOLPH3, Del, G_8, GRGAGGGFHLHEDVARNPTALWSP, (SEQIDNO:9281); XM_848851.3, FAM101B, Ins, G_8, GRGAL-GGPRDAGARRGGEPRGPESST-SPQPTGLCLLTKAVPSVLW, (SEQIDNO:9282); XM_014118866.1, LOC102157316, Del, G_8, GRGGA-RACGLGLVLTPGPQETAAGTEGGGSTAQSPASGAED-EQVAACLRPSHQTKE VTSLWPKG, (SEQIDNO:9283); XM_005616263.1, LRRC4B, Ins, G_8, GRGRGQSPGPARPGARPPQPPPLRG-GRLQGALQRQPQRRGLRGQGPPGAQLHPRTS ALQEWLQGECARDADL, (SEQIDNO:9285); XM_014115679.1, NPAS3, Ins, G_8, GRGRGRGGGRGRR-GRRRGRGRGRGRRPRRGQLLAVHWGPGGAAE-VAGGGQRRAPAG AQGDGDPGRHQHGGAE-GLHHRHHPLRARRGDPGHAGQPAAQRARC, (SEQIDNO:9287); XM_014116573.1, DACT3, Ins, G_8, GRGRPSSPPPLPQPGPGPWHVRRA, (SEQIDNO:9288); XM_005625313.2, DPM2, Del, G_8, GRHPPVLGHVVAGPPTDYDSRRAPRLRAGKPRIRI-RAAASGWGVRSRGTWPRGQTR WWDSASSPLA, (SEQIDNO:9290); XM_545391.3, LOC488269, Ins, G_8, GRHPQEER, (SEQIDNO:9291); XM_005621006.2, TRIM56, Ins, G_8, GRHRGASHGPVPGLCG, (SEQIDNO:9292); XM_014116623.1, HOXB2, Ins, G_8, GRLARGRGVGARAVAGRCLPGAPGFSFPARPQLLR-GRLLSPAVRRPLPQPAGLARQP GSLFR-GRAGLLHQHPLCHRPAVPL, (SEQIDNO:9293); XM_844466.4, MAZ, Ins, G_8, GRPPCPGRRPPATAHLL, (SEQIDNO:9294); NM_001131049.1, DNM1, Del, G_8, GRPPCPPGRGLPLTPSVLP-PRCPRAPTAPRPGSPADRVRQVRPVLRAPGPPSTS, (SEQIDNO:9295); XM_005617051.2, SVIL, Del, G_8, GRPPRMSGSLPSRRF, (SEQIDNO:9296); XM_847680.4, CHERP, Ins, G_8, GRPRQVGPVQGCGRGPGRSIRE-LPPEQELLLHRPHEGQGRVQV, (SEQIDNO:9298); XM_546016.5, ELL2, Del, G_8, GRRACGRS-SATGCRAGGWDRTTSRCCM, (SEQIDNO:9299); XM_014110056.1, LOC102151348, Ins, G_8, GRRGR-WHRM, (SEQIDNO:9301); XM_005638682.2, SHF, Ins, G_8, GRRRRWGQAGAPRAGLPSPRTLPGRAPCTTPGHPGRL-PAAEGARLRRPLLWGAVQL RCCPGHPHRPR-PHAAPAPRLASPPPYTG, (SEQIDNO:9305); XM_005641356.2, SHROOM4, Del, G_8, GRRRSCHP-SISVQKPLV, (SEQIDNO:9306); XM_005624024.1, CCDC40, Ins, G_8, GRSGAPGS, (SEQIDNO:9307); XM_014108010.1, MYO18B, Ins, G_8, GRSPRGGQSR-RASQCTWEVR, (SEQIDNO:9308); XM_005616802.2, PLEKHFI, Ins, G_8, GRVRGLQWGRRGLRRGQGGRR-GRRLAQPRGVLRLGRVLVSLSRL, (SEQIDNO:9309); XM_542166.4, ZBTB7A, Ins, G_8, GRWGRRGPRRGQLRGRTCL, (SEQIDNO:9311); XM_533258.5, SLC22A6, Del, G_8, GSAASSKSRSLWWSSPCS, (SEQIDNO:9312); XM_014106959.1, ADCY7, Del, G_8, GSEQVAMQLAPL-PALTAPVAPSTAWRPSPGPATTSPAPASSSSASCWST-SCSCPGW, (SEQIDNO:9313); XM_544921.5, AIRE, Del, G_8, GSFILPASSKTPVGGRTGPVAAA, (SEQIDNO:9314); XM_014114463.1, LOC106558915, Ins, G_8, GSGAGARTGSCPLHCRTSAELRGHKSLVRCLPSN, (SEQIDNO:9315); XM_014117109.1, ESYT1, Del, G_8, GSHTAPPRRRSCGSACHTRTGPRTPRPGPRAR-WARCS, (SEQIDNO:9316); NM_001284460.1, HTRA2, Ins, G_8, GSLGEGTPADP, (SEQIDNO:9317); XM_547541.5, UBQLN4, Ins, G_8, GSLPWGWGGTPQ-CYCIHTLWLWGHLGPGQPGPRLRQLHGAAAA-DAETADVQS, (SEQIDNO:9318); XM_854614.4, MBD6, Ins, G_8, GSSATPPGGF, (SEQIDNO:9320); XM_014111170.1, PLEKHM2, Del, G_8, GSSAVA-VGGPTPRIGPTPSRSSSPTGRAWS, (SEQIDNO:9321); XM_014121544.1, TTL13, Del, G_8, GSSDCSTAS-WWALRPCRPQARP, (SEQIDNO:9322); XM_549094.4, FGF16, Del, G_8, GSSPPWTGICTASPRLWGTCP, (SEQIDNO:9323); XM_005628039.2, CCDC166, Del, G_8, GTALSRRCRSARSTCSARTRCSRRSWAPARRAW-TRCCGTTPSWTPRRCACARRTGS TPATRARA-PAAAPAPWCGWTSSTART, (SEQIDNO:9324); XM_014119028.1, NRF1, Ins, G_8, GTDRPVWGNRSS-CRSTYWSPRC, (SEQIDNO:9326); XM_014108010.1, MYO18B, Del, G_8, GTLPERWAKQA-SIPVHLGSQVSPGPR, (SEQIDNO:9327); XM_014118241.1, NOTCH4, Del, G_8, GTPPNPVP-MEAPA, (SEQIDNO:9328); XM_014120653.1, PRKAB2, Del, G_8, GTPRRQSLLVPRVPAATPL, (SEQIDNO:9329); XM_014116573.1, DACT3, Del, G_8, GTRAPQLPSPP-STAGPGALARPARLIWPDAIKSELGPA, (SEQIDNO:9330); XM_005625634.2, KCNC2, Ins, G_8, GTRVLLR-PAPGRVRLCAQLLPHRQAALPGRRVRAALRGGAG-LLGHRRDGRGALLL DDLPAAPRRRGGARHLRD-ARPPGWRPRRRRPGGQEAGH, (SEQIDNO:9331); XM_847680.4, CHERP, Del, G-8, GTSETSGT-STRVWAWPWTIHTRTTAGTRATPSSPA, (SEQIDNO:9332); XM_005640347.2, HOXD3, Del, G_8, GVAASLLA, (SEQIDNO:9333); XM_005639284.2, NEU-ROG2, Del, G_8, GVAEACRGRSSPRRCC, (SEQIDNO:9334); XM_005634924.1, ASXL1, Del, G_8, GVARVEVAAGPPMREVAEAAAVVMVVRPVATL-SPVEPRTPLESVRQNSEHNYCRL VL, (SEQIDNO:9335); XM_014122211.1, REXO1, Del, G_8, GVAVPWST-SPRL, (SEQIDNO:9336); XM_014114200.1, SRRT, Del, G_8, GVGALLMAPLSPGATQTSTSCSTMFCLSRPD-FLTGPPPGWAASQRLTWVCHHR, (SEQIDNO:9337); XM_003434769.3, SRRT, Del, G_8, GVGALLMAPLSP-GATQTSTSCSTMFCLSRPGWAASQRLTWVCHHR, (SEQIDNO:9338); XM_014114463.1, LOC106558915, Del, G_8, GVGSWSAHRILSLALPNLSGTAWPQVPGAV-SAIQLEDRLRLP, (SEQIDNO:9339); XM_547555.4, EFNA4, Del, G_8, GVLSAPSVSCCSCCSQFCVSCEFS, (SEQIDNO:9340); XM_544921.5, AIRE, Ins, G_8, GVLYSQQVRRPQWGEEQDP, (SEQIDNO:9341); XM_005642274.1, LOC102152225, Ins, G_8, GVPGR-SALGPPRKGRREARGGCWG-GASLRVCGRAFSGEPVA, (SEQIDNO:9342); XM_014114498.1, C6H16or192, Ins, G_8, GVPSSQF-PALSLFPPSRAVLRMAPGYDITEPPPL, (SEQIDNO:9344); XM_005628921.2, GJA9, Del, G_8, GWGLKCL-GIGEDWSKNSVSWNKGN, (SEQIDNO:9346); XM_003434769.3, SRRT, Ins, G_8, GWGPYLWPPSAL-GPPRRPHHAAPCSAYPGQAGQHRRD, (SEQIDNO:9347); XM_014114200.1, SRRT, Ins, G_8, GWGPYLWPP-SALGPPRRPHHAAPCSAYPGQTS, (SEQIDNO:9348); XM_005642352.1, LOC102157319, Del, G_8, GWILSRKPQL, (SEQIDNO:9349); XM_005624124.2, CD300LF, Ins, G_8, GWKGAGVEVAEQAERGKPREA-QSLCPSREEDLGFLSKVLQPQEGDLCYANL, (SEQIDNO:9350); XM_005634924.1, ASXL1, Ins, G_8, GWPGWRWRRGHR, (SEQIDNO:9351); XM_005640347.2, HOXD3, Ins, G_8, GWQPASWPEL-RAAATTTPSSTATSAPILTHQSWRWSACQEGQG-WAQCFGLLSHHQ QADLPLDER-VPTELQAKEQLCHCRRELRG, (SEQIDNO:9353); XM_005639284.2, NEUROG2, Ins, G_8, GWRRPAG-GALPRDGAAEPGRR, (SEQIDNO:9354); XM_014112752.1, TRIM67, Del, G_8, GWWRLEEDWT-SPTCLFSGS, (SEQIDNO:9355); XM_005617051.2, SVIL, Ins, G_8, VGHPECQEASHLEGSRK, (SEQIDNO:9356); XM_005616205.2, LOC476396, Ins, G_8, VPAGECRV, (SEQIDNO:9357); XM_536395.5, VCL, Ins, G_8, VQNQILLSGGNRRITFVCFCLYLAPEQRLC, (SEQIDNO:9358); XM_014120933.1, LOC100687378, Ins, G_8, VTAHCTPHCPLQVTAHLCPLPTLLPP, (SEQIDNO:9359); XM_005631747.1, SARTI, Ins, G_9, AGSGGKYHPGGVKKTPWGERGGRDDGGGQHRR-RHRAAAAAPGAQKTQAPERRW REQRWRTSE-AESGAWGRARGRAARDRSRDTQRRARAGARPG, (SEQIDNO:9360); XM_543055.4, SALL4, Ins, G_9, AKPHFPEGWWLPREWDPRAGVRDPEITAAGGEH-RQGHHRPQRMSHLPPGLELPKLP QDAL-PHPHRGEAVPV, (SEQIDNO:9361); XM_014116267.1, TMEM235, Del, G_9, GAAASVRVCARVCSCVCK-RVWVCPCVQESVHATRTSSIPGKATGSSGPRER, (SEQIDNO:9363); XM_014106250.1, LOC102153261, Del, G_9, GAAPPWPSLSLPAGP-PAPSARWWFSYQTMTAASQKCLRNTCTMRSHSS, (SEQIDNO:9365); XM_005642470.2, MED4, Del, G_9, GAARARRAGTARGSGCCLRWRTWRSCRENL, (SEQIDNO:9366); XM_014112086.1, LOC106558514, Del, G_9, GAGGVGCVSLAGLLSSQQLSSSPSEPRGCLWSFPGP-FLYVPPRPRLLGVWWERQLYP GLLRLLNRHWRD-SWGLGGT, (SEQIDNO:9367); XM_005635935.2, LOC102152569, Del, G_9, GALGTHCR-VARPSPGCPYRAPGRRGSGPRPGRQCS-PEKPTWGPGRPPHLCALYWSP, (SEQIDNO:9369); XM_005635268.2, OGFR, Del, G_9, GAPRSGPGRPSGPVPSPRGPRWPRR, (SEQIDNO:9371); XM_014107474.1, LOC477353, Del, G_9, GARCP-SASGLGRPVCHL, (SEQIDNO:9372); XM_014118660.1, RECQL4, Del, G_9, GARTPAVSPRRCRSPAAGGRT, (SEQIDNO:9373); XM_005633826.2, ATP7B1, Del, G_9. GASRPSWRPWVTRR, (SEQIDNO:9374); XM_014117894.1, ABCA1, Del, G_9, GASRSSP-STGTRTTTTKPSLVATARTKMLAASMTILRLLIAMI, (SEQIDNO:9375); XM_014121026.1, SPDYC, Del, G_9, GASSSSCPPNCN, (SEQIDNO:9376); XM_014113230.1, STX8, Del, G_9, GAVRRPGRCPEPCIGSHRTAGISR-PARIRAGGCGLPRTPPDSPGLPGQVQAE, (SEQIDNO:9377); XM_014114924.1, LOC607201, Del, G_9, GAWRAPGPWWRGWVAPASRH, (SEQIDNO:9378); XM_014106278.1, LOC106557553, Del, G_9, GEVKGPQESKEDRHRLPTYSLPGPARPQGRPLP-PAEWNPSTPGASPVTTVRIRVEMT AGVLTCFV, (SEQIDNO:9379); XM_536395.5, VCL, Ins, G_9, GFSPGGVQNQILLSGGNRRITFVCFCLYLAPEQRLC, (SEQIDNO:9380); XM_014117418.1, CELSR1, Ins, G_9, GGAVGSRRPAQSGAVVRSGGLRRGPR-GASGGGGQTARGPPTGGV, (SEQIDNO:9381); XM_014119249.1, CSMD2, Ins, G_9, GGDEVQGPNPEALDHSGFMAAL, (SEQIDNO:9382); XM_003639950.2, NCKAP5L, Ins, G_9, GGPRGQEGRLGLPLNPHPIQNV, (SEQIDNO:9383); XM_014120095.1, LOC102155747, Ins, G_9, GHCRG-GRAPGDCAVASATAARGRELGRAGAAVRPTR, (SEQIDNO:9384); XM_014107474.1, LOC477353, Ins, G_9, GHGALRHQASEGQFATCDSFRPQVPHRESRS, (SEQIDNO:9385); XM_539311.4, ADAMTS3, Del, G_9, GKAGNTGPGTGGSSGNSWAT-GAGFSPSWKGPNPSWTTRTGPGSGRTTAGPATGCPA PTSGKRALE, (SEQIDNO:9386); XM_014118660.1, RECQL4, Ins, G_9, GLGRPPCLPADAGAQLL-GAALESGSDAEASRRRLCARLCGGRGRLRGEA, (SEQIDNO:93 87); XM_014106250.1, LOC102153261, Ins, G_9, GLHRLGPRCLCLQGRLLRQQGGGFLTKR, (SEQIDNO:9388); XM_014121026.1, SPDYC, Ins, G_9, GLPHHPAPPTATRARHLHSLYPPEASTMPWAL, (SEQIDNO:9389); XM_014122483.1, LOC106560169, Ins, G_9, GLQEPVGAPSSARRSRPG-GRRTQEARVQLLPPGPAPPLVAEPGAAR-SAAAAWILQSA DEDGAATSGGDGGAGP, (SEQIDNO:9390); XM_014112072.1, LOC100688285, Ins, G_9, GLRGGTLGAAIGPRRDGAPCAPPGASAARPRSST-HAAMRARRGGRAGARGCRQPPG AAVHC, (SEQIDNO:9392); XM_014119640.1, TMEM55B, Del, G_9, GPAAGAPQPPFPVQRSPRSPRDTRPCSRARTRPPTRP, (SEQIDNO:9393); XM_014122483.1, LOC106560169, Del, G_9, GPAGAGGGALERTE-VEAWRTQDAGSSGPAAASGPRPAARR, (SEQIDNO:9394); XM_014114365.1, SETD1A, Del, G_9, GPAL-REKKLGPPPAQLHLPAPAPRPQRPPTRACPSLNIAAWI-PASRCC, (SEQIDNO:9395); XM_847576.4, ZNF428, Ins, G_9, GPGGPISSGPPCSPTPRPPSPALPALWPLTPWGGP-TRHPTLPALLPCYSPPGSSSP, (SEQIDNO:9396); XM_014117894.1, ABCA1, Ins, G_9, GPQDQVPQLVRGQQLQSPLWWQRHGRRCWQLL, (SEQIDNO:9397); XM_005635935.2, LOC102152569, Ins, G_9, GPWGRIAGWRGRPQDAHTAPPGDEAP-AHVPGDSAARRSRRGAQGALHTFALCIGV RRPQRKVGERRPRAWRRPASRVPTT, (SEQIDNO:9398); XM_005633826.2, ATP7B, Ins, G_9, GQAVLPGDPG, (SEQIDNO:9399); XM_014116516.1, DBF4B, Del, G_9, GQLFSVVLGPLTSLSPST, (SEQIDNO:9401); XM_543055.4, SALL4, Del, G_9, GQTTLPRGLVASKGVGPPSRGQRP, (SEQIDNO:9403); XM_003639950.2, NCKAP5L, Del, G_9, GRAPRAGGTTGAPPQPSSYSKC, (SEQIDNO:9404); XM_005635268.2, OGFR, Ins, G_9, GRPGAGRGGRAALSPAPGAQGGRGGEEEKEGGPGPGRRRPGGRRGRRRGGARGGR GARGAGVR, (SEQIDNO:9405); XM_014113503.1, CHRNE, Del, G_9, GRRALAPQLADVQCRGGGLRLRRGRRRRDHQQNRHRHRGLHG, (SEQIDNO:9406); XM_014117418.1, CELSR1, Del, G_9, GRRSGVEASCPERGGGQERGAAPGAAGGFRRRRPDSPRTSDGGC, (SEQIDNO:9408); XM_014106278.1, LOC106557553, Ins, G_9, GRSKVRKRAKKTGTGCQPTASRVPPGLRVGPCLLPSGIHPPRGPLLSRLCESVWR, (SEQIDNO:9409); XM_014115006.1, LOC106558992, Ins, G_9, GRWAAGGSPGAQGQRRSRPRRGRR, (SEQIDNO:9410); XM_014107345.1, LOC106557740, Del, G_9, GSGSRGAKDTFSNARVTPEPSRMKREAGGLAEPWAEDCCFPRVGSLTGPLPFGGFRC HRCSQRRGPRSAGSVRAFGTHPGAS, (SEQIDNO:9411); XM_014117984.1, LOC102154618, Ins, G_9, GSRNHGDGGRLGGATGSRTSAQGRTDRTGQGADHGGR, (SEQIDNO:9412); XM_003640010.2, LOC100856502, Del, G_9, GSWRYFIK, (SEQIDNO:9413); XM_014107345.1, LOC106557740, Ins, G_9, GVEAAAQRTHFQTLVLPPSPRE, (SEQIDNO:9414); XM_545414.4, PRSS16, Del, G_9, GVFARAVSRSRSAGRRRPQPSQRWNDGCTRAGRLARRCGRSWAPAHLWTEPRTRR SCWGRCRPWWGAPCSTTRRPGCR, (SEQIDNO:9415); XM_005642085.2, LOC102156583, Ins, G_9, GWGGGGADGPRPLCSSPWPP, (SEQIDNO:9417); XM_014121460.1, SLC35F5, Del, T_10, FALCGFWQICRIKKHFQTHRLL, (SEQIDNO:9418); XM_014116451.1, RDM1, Del, T_10, FCFFVFFFFFCP (SEQIDNO:9419); XM_014109369.1, MYEF2, Del, T_10, FFPFWQQQLQQRKHQGSFLL, (SEQIDNO:9420); XM_847990.3, OR7C2, Ins, T_10, FHCIWMPGQFTPDRNGL, (SEQIDNO:9421); XM_005630624.2, PHTF1, Ins, T_10, FHDVCGRENI, (SEQIDNO:9422); XM_014121429.1, SPATA5, Ins, T_10, FKRQLPWKNSLYL, (SEQIDNO:9423); XM_014120710.1, GOLPH3L, Del, T_10, FPKVRLGTPSNYSTS, (SEQIDNO:9424); XM_014121429.1, SPATA5, Del, T_10, FQKAIALEKFTL1, (SEQIDNO:9426); XM_847990.3, OR7C2, Del, T_10, FSLYLDAWTIYS, (SEQIDNO:9427); XM_014116451.1, RDM1, Ins, T_10, FVFLFFFFFFVLKILHVP, (SEQIDNO:9428); XM_542851.5, LEKR1, Del, T_10, LEMQPSGKRYPCALGLHLGGRGLRAAGG, (SEQIDNO:9431); XM_014121460.1, SLC35F5, Ins, T_10, LLCVVSGKFVVSRSTFRHTGCYS, (SEQIDNO:9432); XM_014109369.1, MYEF2, Ins, T_10, SFLFGNSSCSSGNIRALFSFRI, (SEQIDNO:9433); XM_014106795.1, LEKR1, Ins, T_10, WKCSHPGSAIPVPWDCTWGAGGSVLQDSRCKHAVKKSTK, (SEQIDNO:9434); XM_005634607.2, LEKR1, Ins, T_10, WKCSHPGSAIPVPWDCTWGAGGSVLQIILLQNSLTVFWEIMDRHIPMHALPEEIQKD SRCKHAVKKSTK, (SEQIDNO:9435); XM_542851.5, LEKR1, Ins, T_10, WKCSHPGSAIPVPWDCTWGAGGSVLQVGRP, (SEQIDNO:9436); XM_538839.5, SLC44A4, Ins, T_11, FHRSHPGAG, (SEQIDNO:9437); XM_014116709.1, LOC106559303, Del, T_11, FIIIEFILVRNPMDVKFVLRHF, (SEQIDNO:9438); XM_014108558.1, LOC106557908, Del, T_11, FLSLSLSLSLSLFLFLFLY, (SEQIDNO:9439); XM_014112116.1, NUDT12, Del, T_11, FSISLFLRKKCLL, (SEQIDNO:9440); XM_014108558.1, LOC106557908, Ins, T_11, FSLSLSLSLSLSFFFFFFIKRLQKKPPTLRDDRRGQFYESHPGLWKILLL, (SEQIDNO:9441); XM_538839.5, SLC44A4, Del, T_11, FSPVASRGWVDTLKTPPSTTTGCPSWSPSWGPMSSPAASSVFLACVWTHSSSVSWKT WRGTTARRTGPTTCPKPFSRS, (SEQIDNO:9442); XM_014113348.1, LOC100688741, Del, T_12, FAFLSFLSATC, (SEQIDNO:9443); XM_014116778.1, LOC102156959, Del, T_12, FFFLFFFFFF, (SEQIDNO:9444); XM_014107785.1, ZNF891, Ins, T_12, FKRKFLTWVKTCFFKESFHQ, (SEQIDNO:9445); XM_005624998.1, LOC100687222, Del, T_12, LTGHNLGGKKTSPLLNPHMLK, (SEQIDNO:9446); XM_014116778.1, LOC102156959, Ins, T_12, SFFFFFFFF1, (SEQIDNO:9447); XM_005637886.1, NSMCE4A, Ins, T_13, LHRKPGGYTECQRQINRGP, (SEQIDNO:9448); XM_014106263.1, NEK5, Del, T_14, LARMEWLQSLWTLG, (SEQIDNO:9449); XM_005624991.1, MED13, Del, T_16, FFPCPPFPTLLQP, (SEQIDNO:9451); XM_005624991.1, MED13, Ins, T_16, SFLVPRFRLFFNRSLVFNLCSLSGRILPFPG, (SEQIDNO:9452); XM_014115014.1, DEGS1, Ins, T_17, FLLYSKVSRDKVLDET, (SEQIDNO:9453); XM_014115014.1, DEGS1, Del, T_17, FPSLQQSIQR, (SEQIDNO:9454); XM_014116451.1, RDM1, Ins, T_18, FVLKILHVP, (SEQIDNO:9455); XM_005635625.2, CBR4, Del, T_22, FSLGVLGFCFFFLSLGASVV, (SEQIDNO:9457); XM_005630622.2, CTSK, Del, T_22, FTALKDSHVKLNT, (SEQIDNO:9458); XM_005630622.2, CTSK, Ins, T_22, LLPSKTVM, (SEQIDNO:9459); XM_014109132.1, TDRD1, Del, T_24, FVYWECCLLCLCLCLPAILLLGWVVLFFSLSSSSQINLA, (SEQIDNO:9460); XM_014109132.1, TDRD1, Ins, T_24, LFIGNVVSCASVFVCLPFFC, (SEQIDNO:9461); XM_005618433.2, MORF4L1, Del, T_25, LLLQVSEYCAFMGLFFMKQSV, (SEQIDNO:9462); XM_545128.5, SLC15A2, Ins, T_7, CAPAGPDAGTKSSSGSYLHPAV, (SEQIDNO:9463); XM_005616820.1, TMC1, Ins, T_7, CASCRCASRTLLGNNGGTGICAADCF, (SEQIDNO:9464); XM_539698.4, PTPRQ, Ins, T_7, CCCKNCKRTWSFQYSFLLHR, (SEQ1DNO:9465); XM_847422.4, YIF1A, Ins, T_7, CCGHSLCGQEAGAPGLPLHTPELGSAVQS, (SEQIDNO:9466); XM_014109476.1, STARD9, Ins, T-7, CCSEQTFSFN, (SEQIDNO:9467); XM_005639633.1, ATP13A3, Ins, T_7, CCVCDYFVCFHITHHVASSCLY, (SEQIDNO:9468); XM_014114990.1, DIEXF, Ins, T_7, CEQDFASVS, (SEQIDNO:9469); XM_846061.4, CPB2, Ins, T_7, CERIRCKQCESSFTRQHHPIQSLGGRSERSYPTANLQQHPQPPDLLLLL, (SEQIDNO:9470); XM_005628406.2, SMO, Ins, T_7, CGEHWLVGPVYGRRSPGDCLPCRWHHETWGAHLQ, (SEQIDNO:9471); XM_005630852.2, LOC100686848, Ins, T_7, CGFYCCKWSVSSASTFNLQLHWVLCLCGLPWICIWMAQLSVV, (SEQIDNO:9472); XM_005632588.1, PFKFB4, Ins, T_7, CGVHLCGS, (SEQIDNO:9474); XM_005626092.1, LHCGR, Ins, T_7, CHLSCLQNAPHHSNQL, (SEQIDNO:9475); XM_005631833.2, LOC483842, Ins, T_7, CHNECKNE, (SEQIDNO:9476); XM_014122642.1, FAT3, Ins, T_7, CHQYQNRFDHNNFKEIGSRTAGRTFSRGDCDGWRLLSQTIHHLGGGSGFG, (SE- QIDNO:9477); XM_533782.4, DENND6A, Ins, T_7, CKNTPALATHYSNRRP, (SEQIDNO:9478); XM_544956.5, THAP9, Ins, T_7, CKQGIRIFASSVAASYHWQTE, (SEQIDNO:9479); XM_549283.3, ADGRG4, Ins, T_7, CLGTCEDLFLISFCHFQHVARIPHFHVLLRNEGECAGAVADTLLLRVVTTG, (SEQIDNO:9480); XM_014109908.1, ANK2, Ins, T_7, CLQRKPTSSLCQGT, (SEQIDNO:9481); XM_014109884.1, EGF, Ins, T_7, CNVPFWESDLLFNMEKEDNLDS, (SEQIDNO:9482); XM_542919.5, SLC4A11, Ins, T_7, CQRQPRGAAQPGC, (SEQIDNO:9483); XM_014114457.1, OPYD, Ins, T_7, CQVDPKCH, (SEQIDNO:9484); XM_532487.2, ITGB8, Ins, T_7, CRRICPPAKLPAGSSPVPSGGLGAFSCSWTGPK, (SEQIDNO:9485); XM_005617468.2, BDP1, Ins, T_7, CSFASESSC, (SEQIDNO:9486); XM_005630848.2, SLC16A1, Ins, T_7, CSFYCCKWSVSSASTFILQLHWVLCLCGLLWICVWMAQLSVV, (SEQIDNO:9487); XM_005637418.1, COR8S14, Ins, T_7, CSHLLPHTV, (SEQIDNO:9488); XM_005627566.2, BCKDHB, Ins, T_7, CSLPRNQGGCTQKPFPGQGTSFVMHRG, (SEQIDNO:9489); XM_014106638.1, NOD2, Ins, T-7, CSPVPCAQH, (SEQIDNO:9490); XM_846025.3, ADAMTS5, Ins, T_7, CSQEVHPKSQLSHQPCQQ, (SEQIDNO:9491); XM_014118470.1, POLH, Ins, T_7, CSSGTAAKSSFEE, (SEQIDNO:9492); XM_541002.4, PTPN4, Ins, T_7, CTLFYIRFKISVLWKN, (SEQIDNO:9493); XM_548259.5, PEX12, Ins, T_7, CTTTSIHPREGSASFTTAEAGWSSARSTYSSGHTGSGAQAS, (SEQIDNO:9494); XM_014118588.1, CSMD3, Ins, T_7, CTYICRIWILSL, (SEQIDNO:9495); XM_014119192.1, VWDE, Ins, T_7, CVLTTAHSGMYGILCRSYF, (SEQIDNO:9496); XM_014110567.1, ATXN1, Ins, T_7, CVWTGMLLSRENQPALRPAVLQALRWGRLHLADPQEPEERLC, (SEQIDNO:9497); XM_014118473.1, MRPL14, Ins, T_7, CWALGPLHSCKQSIQPAQFQHHWELQCNSEDDAGPCGGQQCPGEYSVPSPSSLHPC L, (SEQIDNO:9498); XM_014111411.1, LOC611589, Ins, T_7, CWCLLLSIFGRCDLWGFKQNIPQGVRYCANKPIKRFRKRTIGNS, (SEQIDNO:9499); XM_544475.5, NUDC, Ins, T_7, CWRRGDGREAHHTDLQPP, (SEQIDNO:9500); XM_014114453.1, NTNG1, Ins, T_7, CWTMATQYGFSLRTAGYNQETQRFLYSHRPEDKAFETSGWGNICR, (SEQIDNO:9501); XM_538213.3, LOC481092, Ins, T_7, CYISWGNRILPLGFYVL, (SEQIDNO:9502); NM_001313886.1, LOC100683286, Ins, T_7, CYISWGNRVLSLGFYVL, (SEQIDNO:9503); XM_014117454.1, ARHGAP25, Del, T_7, FAEIRMCTQWPPC, (SEQIDNO:9505); XM_005631134.2, HIPK3, Del, T_7, FAEKQRFLILVGD, (SEQIDNO:9506); XM_014111169.1, LOC610561, Ins, T_7, FAFFWQCGPHVPTLLCHLLLIGYSHCSGLCSFVSLLQPHHL, (SEQIDNO:9507); XM_540660.3, LOC483540, Ins, T_7, FAFHPYLLHHSGR, (SEQIDNO:9508); XM_014115201.1, KIFAP3, Del, T_7, FAFLAFLSFMDLSLTIKLELYV, (SEQIDNO:9509); XM_014113716.1, ALG6, Del, T_7, FAFYLASVLKKA, (SEQIDNO:9510); XM_005625977.2, RANBP2, Del, T_7, FAIVQNCFVLM, (SEQIDNO:9512); XM_003433059.3, SPRY2, Ins, T_7, FALFMVLPSSQGLP, (SEQIDNO:9513); XM_014113929.1, CENPBD1, Del, T_7, FALLKNTVPRIISPIKHCSS, (SEQIDNO:9514); XM_014112649.1, RBPJ, Del, T_7, FALLLVCILWAVDGRKKKNKWNGMVVLNKSLNHVHLLE, (SEQIDNO:9515); XM_005628714.2, BBS9, Del, T_7, FALRIMDRFDS, (SEQIDNO:9516); XM_846518.4, C4BPB, Del, T_7, FAMPLWSGTPPFPHVSWATVLSLCW, (SEQIDNO:9517); XM_005634703.2, LOC606793, Del, T_7, FAPLLLQPNLGNLSSLC, (SEQIDNO:9518); XM_014119800.1, LOC106559804, Ins, T_7, FAPMPAASQTRGTLASWPGTRGSPGPRTTVLRLPAASATGGRAEKAMGMPEGTRGR QWARAAFWVGDSGQPCLLEGSPGGPPPPRPAAGAYRISCC, (SEQIDNO:9519); XM_014120611.1, AP4B1, Del, T_7, FAPTRSPTTSSCRRWRCCVSW, (SEQIDNO:9520); XM_014116753.1, LIG3, Ins, T_7, FARVACGTLQWAL, (SEQIDNO:9521); XM_014119949.1, TBXAS1, Del, T_7, FARVSGKAKWSSESYMDLCVGTILVAGCLLLSLSQT, (SEQIDNO:9522); XM_014118520.1, LRP12, Del, T_7, FASQEIFIVKTIGVCLKAGCVILRMTAVMAAMRRIAQLLCLPES, (SEQIDNO:9523); XM_014117160.1, APOF, Del, T_7, FATSCCTLWMSFHMETGQTFPHL, (SEQIDNO:9524); XM_014110296.1, GRAMD1C, Ins, T_7, FAVASSVECDAVSEAVKDRICCSVLLPSPSPRREIFTFSL, (SEQIDNO:9525); XM_014118505.1, ADGRF2, Del, T_7, FAVKRNGTRSLKPAGLLMPSTSLRQIYIQLNHSKEIQKSVSMPECLRLSQTC, (SEQIDNO:9526); XM_014115233.1, EXO1, Del, T_7, FAVLWILPTVYL, (SEQIDNO:9527); XM_005624276.2, GNA13, Ins, T_7, FAVSPYHKSTVGRQWHTECL, (SEQIDNO:9528); XM_005640538.2, CFLAR, Del, T_7, FCAGTLLQMLLHLLSGTFWIF, (SEQIDNO:9529); XM_014111169.1, LOC610561, Del, T_7, FCFFLAMWPSCTYASLPPTPYSGIQSLLWPLQFCLPSSTPSFIA, (SEQIDNO:9530); XM_005631715.2, RCN1, Del, T_7, FCFLFFFF, (SEQIDNO:9531); XM_003433951.2, LOC100684620, Del, T_7, FCFLLYFT, (SEQIDNO:9532); XM_005630716.2, CD160, Ins, T_7, FCFSHRDRELHRGSTETYRTARVQSQ, (SEQIDNO:9533); XM_003433948.1, LOC100684112, Del, T_7, FCFSPHACFCTSGLLPHLQLIKICSLWILLSSLP, (SEQIDNO:9534); XM_540660.3, LOC483540, Del, T_7, FCFSPLFTSPLWQVTGA, (SEQIDNO:9535); XM_014119604.1, TMPO, Del, T_7, FCFWSIKLWKPTKEIRSVVFFLMTLVNPS, (SEQIDNO:9536); XM_014118650.1, CWH43, Del, T_7, FCGCLLVWDY, (SEQIDNO:9537); XM_005642440.1, LOC100688648, Del. T_7, FCHVRKNKCQNHQRRTEENRNMGIRIMKMLSSS, (SEQIDNO:9538); XM_014108289.1, LOC102156424, Del, T_7, FCIWLWAYVSSAKVAFCSVV, (SEQIDNO:9539); XM_014107328.1, PARP4, Del, T_7, FCLFLKEFLLLVHPEGLTFITILILLFIFKIL, (SEQIDNO:9540); XM_545339.4, GCM2, Del, T_7, FCLGHLAAMNWQLLVTQIQAHIPPFIRILAMSLMTQTGFI, (SEQIDNO:9541); XM_014113785.1, ZCCHC2, Del, T_7, FCLRLLMQTDWCMTQSWGAKPTTACSRWRDLGGSILCTQHRT, (SEQIDNO:9542); XM_003433059.3, SPRY2, Del, T_7, FCLVYGVTFQPRVALSCARGVMTGLTGLDAAVKTQTQFAAKFPLSHPGTLKNQH, (SEQIDNO:9543); NM_001286967.1, ARHGAP18, Del, T_7, FCMKLEEILENAALMTTRT, (SEQIDNO:9544); XM_005636714.2, ASUN, Del, T_7, FCMSLAVLDPF, (SEQIDNO:9545); XM_005632290.2, NUP210, Del, T_7, FCPAFLASSHPCHLPGQRWPV, (SEQIDNO:9546); XM_014113223.1, DYNC2H1, Del, T_7, FCQQETQIPSSHQMQPPSLQRLTSLQQEVGCEDSFWL, (SEQIDNO:9548); XM_547742.5, NRL, Del, T_7, FCRCTPRKPAPEWHCLPAPWLWNMSMTLT, (SEQIDNO:9549); XM_005633637.2, TRIM66, Del, T_7, FCSAFLQGDPRWPGTAPSARRRGQRISCAP- TATAGCAAHAQRSTGMAPPLGAHSFR GPTRDHQE, (SEQIDNO:9550); XM_014120068.1, RAB11FIP1, Ins, T_7, FCSSVQFWPDTCPF, (SEQIDNO:9551); XM_005640646.2, RQCD1, Del, T_7, FCTPFCTLSAKHDPLNIFD, (SEQIDNO:9553); XM_014110028.1, TSPAN5, Ins, T_7, FCVPGNYFLPGAHCWGSGICFQRLDQRPAVFLYKQQHQSVQR, (SEQIDNO:9554); XM_544884.5, KCNJ15, Del, T_7, FCWLLSWSLRP, (SEQIDNO:9555); XM_014110333.1, SLC12A7, Ins, T_7, FDLHLPQRSHHPGRDGGG, (SEQIDNO:9557); XM_005637629.2, SLF2, Ins, T_7, FDNTRLSYLCLSLCPVSCTCVKVAVSDDVGSYRLYCVCADFKYIDGNND, (SEQIDNO:9558); XM_005615336.2, CDH19, Ins, T_7, FDPGSETAKEANSIS, (SEQIDNO:9559); XM_014120725.1, LOC607038, Del, T_7, FDVALPKMQYIIARMVATVKWTCTCVGNVKSAD, (SEQIDNO:9560); XM_005639030.2, PRMT2, Ins, T_7, FEAQVQPHFEARRLSV, (SEQIDNO:9561); XM_005635818.2, SP140, Ins, T_7, FEDSILLLY, (SEQIDNO:9562); NM_001145170.1, CA2, Ins, T_7, FEDWWCQSRPTKNP, (SEQIDNO:9563); XM_014116438.1, ABCA6, Ins, T_7, FEEKMGSWILLKFVQK, (SEQIDNO:9564); XM_014122642.1, FAT3, Ins, T_7, FEGPRWWWENDFLHCESDRCG, (SEQIDNO:9565); XM_014110533.1, LOC488248, Del, T_7, FEIRTLAKITSSTRIRITCGHARICASIKEACS, (SEQIDNO:9566); NM_001313773.1, RPGRIP1, Ins, T_7, FELPSRGFSSA, (SEQIDNO:9567); XM_014111835.1, ZMAT1, Ins, T_7, FEMFVRLS, (SEQIDNO:9568); XM_532205.6, CD109, Ins, T_7, FESSLYYQR, (SEQIDNO:9569); XM_014110011.1, INTS12, Ins, T_7, FESTRLLTFKE, (SEQIDNO:9570); XM_005633847.2, KPNA3, Ins, T_7, FETSPFTTSEC1, (SEQIDNO:9571); XM_005615672.2, LOC483960, Del, T_7, FEWSFLTLPQDEQMLTISSMKLKGLERIY, (SEQIDNO:9572); XM_849082.4, TMEM182, Ins, T_7, FFACWITIPGYWSTYSNTSL, (SEQIDNO:9573); XM_005620968.2, WBSCR22, Ins, T_7, FFALLCAGSWSPGRPAAIPGELRAVGANYDPGHQGWLHWWRGCGLPQ, (SEQIDNO:9574); XM_849728.3, MYCT1, Del, T_7, FFCLFYFLWILWLITQQV, (SEQIDNO:9575); XM_005633797.1, COR52E4, Ins, T_7, FFHDTPFWSKHPPLYPYPFS, (SEQIDNO:9576); XM_005623261.2, TM9SF1, Ins, T_7, FFPKVHPLYLC, (SEQIDNO:9577); XM_005636001.2, PPP1CC, Del, T_7, FFSEETMNVPASIEFMDFTMNVKEDITLNYGKLSQTALTVYR, (SEQIDNO:9578); NM_001003033.1, PPP1CC, Del, T_7, FFSEETMNVSASIEFMDFTMNVKEDITLNYGKLSQTALTVYR, (SEQIDNO:9579); XM_005635807.1, TRIP12, Ins, T_7, FFTTSWRRAHWKSRTSG, (SEQIDNO:9580); XM_532457.5, CYP51A1, Ins, T_7, FGAEENAKKWP, (SEQIDNO:9581); XM_536257.5, KLB, Del, T_7, FGALGLEHFKWKGIGRQMEKDPLYGIISSTHTLKMSTA, (SEQIDNO:9582); XM_005632409.2, ASB14, Ins, T_7, FGCQHLPLRKCQFSSSQWLQSECQEF, (SEQIDNO:9583); XM_003640306.1, LOC100855565, Ins, T_7, FGDIPVGLDRQPPHYHCNQLGPSPTVPHVLLLEAPLSSGPLLHLCHSPPVHHKFTYEQ WLHFLCPVHSSGVLLHSSGLIRSGHPHSDVL, (SEQIDNO:9584); XM_014112077.1, MAN2A1, Del, T_7, FGDRIGIWDLAQIFFAT, (SEQIDNO:9585); XM_003432273.2, LOC100683523, Ins, T_7, FGDWVLAMWAGEFCDTHSAGSHTHSLWAQPNQPLSL, (SEQIDNO:9586); XM_003639984.3, BTAF1, Ins, T_7, FGEGSSMAGSN, (SEQIDNO:9587); XM_539359.3, OR2T2, Ins, T_7, FGGCHSQCGHDSTHPC, (SEQIDNO:9589); XM_843573.4, DARS, Ins, T_7, FGIAQCSSDVNVPPGS, (SEQIDNO:9591); XM_014119713.1, FHDC1, Del, T_7, FGKPFQRSKFVAKPTSGLWPPGSSITTRLIQRPLRNSLGSKKILPSLPFLGEEEL, (SEQIDNO:9592); XM_014115860.1, CTAGE5, Ins, T_7, FGKPVKRREI, (SEQIDNO:9593); XM_005616941.2, CUL2, Ins, T_7, FGKSRTAFAQESSGV, (SEQIDNO:9594); XM_534336.5, CSRP2BP, Del, T_7, FGLALTCLSA YSIQTSVLLSFIKKSSLPLASWYLM, (SEQIDNO:9595); XM_014107454.1, UGT1A6, Ins, T_7, FGLKSIKRQS, (SEQIDNO:9596); XM_005630347.2, CEBPZ, Del, T_7, FGLVSRKKILNQKCLVPF, (SEQIDNO:9597); XM_533578.4, NLRP9, Ins, T_7, FGLWLVVVPGGAQKGRILEI, (SEQIDNO:9598); XM_014119438.1, C15H12orf29, Del, T_7, FGMLRKTSNLFQSAGYQRRK, (SEQIDNO:9599); XM_005638131.2, FSBP, Del, T_7, FGMSVENTLGHN, (SEQIDNO:9600); XM_844183.4, ESRRG, Ins, T_7, FGNAGGQGL, (SEQIDNO:9601); XM_537895.5, LOC480777, Del, T_7, FGNFMNVLRSSVKM, (SEQIDNO:9602); XM_845265.4, UTS2B, Ins, T_7, FGNGAWTAISYPRK, (SEQIDNO:9603); XM_005621497.2, TMC5, Del, T_7, FGNQTIPELRTLQTFGGNLITQSLRMVVIMALLRLQKLPERCSAEHLHSGPHCVIGVM ALWGSLGERMKITLKTLQ, (SEQIDNO:9604); XM_003640134.2, OTOL1, Ins, T_7, FGNRWYGHSSKDHTTYQIYEEI, (SEQIDNO:9605); XM_014119195.1, MTERF1, Del, T_7, FGPVTTET, (SEQIDNO:9606); XM_014119721.1, ENPP1, Del, T_7, FGQDQMWKLKEFSQTSIKCIMVQYHLKKGF, (SEQIDNO:9607); XM_003435483.1, FOXR2, Del, T_7, FGQLQMAGKTPSATISVSWAALRRHQSIFRMGPM, (SEQIDNO:9608); XM_014122196.1, DOCK6, Ins, T_7, FGRDPRRPQTLQAS, (SEQIDNO:9609); XM_845208.4, HECTD1, Ins, T_7, FGSASKTWCNQQSINFGRSFL, (SEQIDNO:9610); XM_014118865.1, UTRN, Ins, T_7, FGSNGKRSQITLPNGGILYTYNIWGRCTRLHKGAEE, (SEQIDNO:9611); NM_001012395.1, UTRN, Ins, T_7, FGSNGKRSQITLPNGGILYTYNTWGRCTRLHKGTEE, (SEQIDNO:9612); XM_847187.3, TXNDC12, Ins, T_7, FGSQWQGAS, (SEQIDNO:9613); XM_005624856.2, KIAA0100, Del, T_7, FGSRMSALSFSNTSKLWKLIACGFPANSLAMICHAMWHCALEKYVSGRTYRRFLAF LPHFPKALGYIKRNCLSVHPY, (SEQIDNO:9614); XM_005639633.1, ATP13A3, Del, T_7, FGSSSNLGMKYGIHNQMMQREAYIGILLHICTMKLNLIRVIYKIMKIPQCFLSPVFSTS, (SEQIDNO:9615); XM_536122.5, RAB3GAP2, Del, T_7, FGSVCMEKALPRICVTLWSQLDLALSCCCLCS, (SEQIDNO:9616); XM_005627518.2, PHF3, Del, T_7, FGTPMLNIRTNTEV, (SEQIDNO:9617); XM_005639761.2, B3GNT5, Del, T_7, FGTQSIITL, (SEQIDNO:9618); XM_014119897.1, ZNF283, Del, T_7, FGVQALLNMR, (SEQIDNO:9619); XM_536500.4, NUP155, Ins, T_7, FGWKRWLFI, (SEQIDNO:9620); XM_014119539.1, ABCE1, Ins, T_7, FGWLRSNRKLEIQRCLTCF, (SEQIDNO:9621); XM_014112250.1, PAPD4, Ins, T_7, FGWVLFKWIWYPEQ, (SEQIDNO:9622); XM_540733.1, LOC483613, Ins, T_7, FHALLRWH, (SEQIDNO:9623); XM_541402.3, LOC484287, Del, T_7, FHAYMRLRRKTL, (SEQIDNO:9624); XM_005629095.2, KLF18, Ins, T_7, FHEPKGDV, (SEQIDNO:9625); XM_533330.4, SLC35F5, Del, T_7, FHFLLQLSYAIIIGIL, (SEQIDNO:9626); NM_001003027.1, AFP, Ins, T_7, FHFPTKFF, (SEQIDNO:9627); XM_005635483.2, USP1L, Ins, T_7, FHFSIKFFSK, (SEQIDNO:9628); XM_014109484.1, TMEM87A, Ins, T_7, FHGDVYCICPVWCSVAGMVCLLLERSPENS- VLDWCCHLLGNA, (SEQ ID NO:9629); XM_003639544.3, EN2, Ins, T_7, FHGQLLAARVRPEEQPGDVLCRRGRRKRRRRRGRRRGRRGRRRRR-GRRRAAPGV GPRGPAERARGARGGRAS-WRRRRRHSG, (SEQ ID NO:9630); XM_003431626.3, FNIP1, Del, T_7, FHIFLSLKAT, (SEQ ID NO:9631); XM_005637011.2, TMTC1, Ins, T_7, FHKRKPTKRAESSG, (SEQ ID NO:9632); XM_005628579.2, AGMO, Ins, T_7, FHLHCFLGSQKHETTCLQPFEI, (SEQ ID NO:9633); XM_014108701.1, LOC611536, Ins, T_7, FHLTSQCLFYCKLFGEQGQLLSFWLESLPVQLLSSS, (SEQ ID NO:9635); XM_014115681.1, RALGAPA1, Del, T_7, FHLVCLVPQCLLWILL, (SEQ ID NO:9636); XM_014106710.1, SLC4A7, Ins, T_7, FHNIFSVFIPQAI, (SEQ ID NO:9637); XM_014118177.1, BVES, Ins, T_7, FHNWVGYSNYTSPSYDTS, (SEQ ID NO:9638); XM_005638361.2, CTDSPL2, Del, T_7, FHQQIKMEHQDPIPQDRLWKLKK, (SEQ ID NO:9639); XM_547829.5, TMEM260, Ins, T_7, FHRFQAFWLICWRNPCCGGVFIFSSNMAVVHCSRGF, (SEQ ID NO:9640); XM_014114384.1, TNNBK, Ins, T_7, FHSAAHCSILWT, (SEQ ID NO:9641); XM_005639144.2, ARHGAP24, Ins, T_7, FHVWGADSGTEEN-RERKHNMDPV, (SEQ ID NO:9643); NM_001003106.1, CTLA4, Del, T_7, FIAFLSQLFL, (SEQ ID NO:9644); XM_849878.4, ZDHHC14, Del, T_7, FICLFYLCLF, (SEQ ID NO:9645); XM_005639457.2, CD47, Ins, T_7, FICWWTSAHYSCHCRSHSFRPR, (SEQ ID NO:9646); XM_847055.3, LOC609729, Ins, T_7, FIFGVHINCDGKPPHHGHCDL, (SEQ ID NO:9647); XM_014109438.1, MYO9A, Del, T_7, FIFPNKTH, (SEQ ID NO:9648); XM_533330.4, SLC35F5, Ins, T_7, FIFYCNSLMPL, (SEQ ID NO:9649); NM_001172235.1, UGCG, Ins, T_7, FIGIMGPYYKLENWSLQIALWRHSRGNSRCI, (SEQ ID NO:9650); XM_005633841.2, ALG11, Del, T_7, FIHYSSLG, (SEQ ID NO:9651); XM_003433028.1, LOC100685902, Ins, T_7, FIICFDTPLSAEAEFSRSCI-QSPKYLYFPSHPNFILLHCHC-CHFYYPQCNNDSSPHPSSA, (SEQ ID NO:9652); XM_005638476.2, VPS13C, Del, T_7, FIIDKIMALY, (SEQ ID NO:9653); XM_547308.5, LPAR3, Del, T_7, FIIGATQTLPMSGQERSW, (SEQ ID NO:9654); XM_005627902.2, TBC1D31, Del, T_7, FIIGITWI, (SEQ ID NO:9655); XM_535047.6, PSTK, Del, T_7, FIMRKITLSGNIFQSHT, (SEQ ID NO:9656); XM_005624915.2, GEMIN4, Del, T_7, FIPRYSVTFCTSWPCSPTRCASRCMSWPWKSSPAMKP, (SEQ ID NO:9657); XM_005627580.2, DOPEY1, Ins, T_7, FIQFWVISSSCKCCHVCEANVAESVRDILLAFG, (SEQ ID NO:9658); XM_005631925.2, MGAT4D, Del, T_7, FIQTYYLSHSQLRTREN, (SEQ ID NO:9659); XM_544123.3, TRPA1, Ins, T_7, FIQYIWILQRSDPNLPTEKELYVGSGQCS, (SEQ ID NO:9660); XM_014111169.1, LOC610561, Del, T_7, FIRPRTSS, (SEQ ID NO:9661); XM_005622851.2, EPG5, Del, T_7, FISFGYPHWTLKALVCSQNGVLTWLI, (SEQ ID NO:9662); XM_014109687.1, SYNJ1, Del, T_7, FISMEVKSKDARVVLFEQTAWTVLIEQIVCRHSLA, (SEQ ID NO:9663); XM_533983.5, CCDC81, Ins, T_7, FITIHFHQTKCGIYFQRNWGPCD, (SEQ ID NO:9664); XM_856309.4, KDELR2, Ins, T_7, FITMYKDFFTQRNL, (SEQ ID NO:9665); XM_005633788.1, OR52E1, Ins, T_7, FIYDPQVWPEYTTLYPHPFG, (SEQ ID NO:9667); XM_014122769.1, RIC3, Ins, T_7, FNINSI, (SEQ ID NO:9668); XM_847424.4, GLIPR1L1, Ins, T_7, FKGNKKLEKYEKYPDWNPQGTAPQHISCNPLCL, (SEQ ID NO:9669); XM_005636226.2, HVCN1, Ins, T_7, FKIICLPLGVLSPQI, (SEQ ID NO:9670); XM_014119270.1, LOC102151283, Del, T_7, FKKQKLSLPNIMRK, (SEQ ID NO:9671); XM_005622271.2, CAMSAP2, Del, T_7, FKLRICPMILRMLSCTGLIR, (SEQ ID NO:9672); XM_005628968.1, ZMYM6, Ins, T_7, FKPKAFRLGQVFS, (SEQ ID NO:9673); XM_534667.5, RNF34, Ins, T_7, FKPYSPFCYCVFISGRLYGWRPDLGIWSSGTGTK, (SEQ ID NO:9674); XM_014113138.1, C4H5orf42, Ins, T_7, FKQEHRPKCMGPLYL-STFSSVFINPVLGYEIQTRCGTFGKADLKYYKAFADSATTGS VILREAFG, (SEQ ID NO:9675); XM_014109139.1, CFAP43, Ins, T_7, FKRSSKVPK, (SEQ ID NO:9676); XM_005626122.2, PAPOLG, Del, T_7, FKSIDIILY, (SEQ ID NO:9677); XM_003435457.4, FANCB, Ins, T_7, FKSRRSFK, (SEQ ID NO:9678); XM_014116723.1, RNFT1, Ins, T_7, FKSYIGPFKLLGSTLDCWNYRLHSEIPLHGLKMPYFVDAFFHHAF, (SEQ ID NO:9679); XM_014108367.1, LOC611565, Del, T_7, FKTTRSNASPIVGMLE, (SEQ ID NO:9680); XM_862279.4, G3BP1, Del, T_7, FKVMGMWWSY-ALTVAGNYPILVLLCLMILSLFKRSLATGPSCSEVRSA, (SEQ ID NO:9681); XM_547621.5, B4GALT6, Ins, T_7, FLASDSNAPEAEVGICLLCH, (SEQ ID NO:9682); XM_014107880.1, SSH1, Del, T_7, FLAYLHIITS-ESMMKRQQTFLPTGTKHTIL, (SEQ ID NO:9683); XM_003639673.1, LOC100856189, Ins, T_7, FLCHYIIHFKKSLSRRKTQSPLYLWISYHGYS-FIFWAFHLCLP, (SEQ ID NO:9685); XM_849082.4, TMEM182, Del, T_7, FLCLLDYYSWLLVDIFKYIT, (SEQ ID NO:9686); XM_014110908.1, LOC100686469, Del, T_7, FLCLPLSASEDSTKLESHHLRLPDKLQEFR-GLLQLKKKMVIFQTL, (SEQ ID NO:9687); XM_844911.2, LOC608017, Ins, T_7, FLCNKCNDGMLFAGNNGL, (SEQ ID NO:9688); XM_003434058.3, LOC100684793, Ins, T_7, FLCNQCNDRMLFAGNNGL, (SEQ ID NO:9689); XM_545065.3, OR5H2, Ins, T_7, FLCNQYNDGMLFAGNNGL, (SEQ ID NO:9690); XM_014110028.1, TSPAN5, Del, T_7, FLCSWELFSSWSSLLGFWHLFSKTGSKTSCISL, (SEQ ID NO:9691); XM_014112224.1, ADGRV1, Del, T_7, FLDKVTQQSTLLSKLMTHQK, (SEQ ID NO:9693); XM_005640225.2, 42436, Del, T_7, FLEDLARIP, (SEQ ID NO:9695); XM_014109449.1, ZNF106, Del, T_7, FLENTQIP, (SEQ ID NO:9696); XM_014115269.1, DNAH14, Del, T_7, FLEQHFQQQIKLPWRKQYLLQHNSWAYNNGQLRKRKSYSFIINCRLVLV, (SEQ ID NO:9697); XM_014117392.1, KIAA1033, Ins, T_7, FLFESNSIFQSFY, (SEQ ID NO:9698); XM_005633595.2, LOC100685491, Ins, T_7, FLFHPPLWPPSTSSCPHCTCKSLPSCAPCSQPPGLWH, (SEQ ID NO:9699); XM_005638667.1, LOC487459, Ins, T_7, FLFILCWNYLRKPLHYVNSDF, (SEQ ID NO:9700); XM_846785.4, BTBD10, Ins, T_7, FLFLCVYLGIY, (SEQ ID NO:9701); XM_005618393.2, BTBD1, Ins, T_7, FLFQLPWQ, (SEQ ID NO:9702); XM_014121827.1, PTPRS, Ins, T_7, FLFYFLYRGLAHAIRQVDVWGRRPDA, (SEQ ID NO:9704); XM_536170.5, MCEE, Del, T_7, FLGFRHRFQK, (SEQ ID NO:9705); XM_005617241.1, SLC6A2, Ins, T_7, FLGGWIWSPDCICQLQQI, (SEQ ID NO:9706); XM_533741.5, SLC6A11, Ins, T_7, FLGNSSGTIHE, (SEQ ID NO:9707); XM_537209.4, MPC2, Ins, T_7, FLGSNYEMGVGVCRIG, (SEQ ID NO:9708); XM_005635807.1, TRIP12, Del, T_7, FLHHFLEKSPLEE, (SEQ ID NO:9709); NM_001164486.1, SELENOI, Del, T_7, FLHVCYSFCLQHGSFSRLQIF, (SEQIDNO:9710); XM_014119426.1, FNIP2, Del, T_7, FLIFPCLNLT, (SEQIDNO:9711); XM_005641570.2, ARMCX1, Ins, T_7, FLIQRIWSVC, (SEQIDNO:9713); XM_014119702.1, CFAP54, Del, T_7, FLKPFMRYPRFFMEKTCLPQY-PLAVRLLEK, (SEQIDNO:9714); XM_014120068.1, RAB11FIP1, Del, T_7, FLLFCPVLARHLSLLNW-GIVQRHHPLNLLLSSLSHLPLWLPFPH-PRQLKTGPPQTRAR PVLKNHLCSIRQNC, (SEQIDNO: 9715); XM_005625434.1, QSOX2, Ins, T_7, FLLFEVVAGCEEKIDFVA, (SEQIDNO:9716); XM_843974.3, NEMP1, Ins, T_7, FLLFKREIE, (SEQIDNO:9717); NM_001145507.1, CAFA-T2R43, Del, T_7, FLLLLFLMSM, (SEQIDNO:9718); XM_005641635.2, TBC1D8B, Ins, T_7, FLLLVFELSSIEVP, (SEQIDNO:9719); NM_001003176.1, RPE65, Ins, T_7, FLLPRSGGH, (SEQIDNO:9720); XM_847656.3, LOC610217, Ins, T_7, FLLQPPFWTCITLCSYSLVYHLSACAACP, (SEQIDNO:9721); XM_014117993.1, LOC100685402, Ins, T_7, FLLYVYPLHHLENELSYRETQSLFHLLSTSDRG-DHILWYHLLHVCQAQVSRPPRE, (SEQIDNO:9723); XM_539781.2, ASICS, Ins, T_7, FLMEY-RVQSRPSSGNQVQLLWL, (SEQIDNO:9724); XM_859377.4, UPF3B, Del, T_7, FLMILVCILICMPEHT-STLKTKRTLFCSGIALMVMYSLTIKVRNILL, (SEQIDNO:9725); XM_005637170.2, KLRB1, Del, T_7, FLMLPTLGKTV, (SEQIDNO:9726); XM_003639673.1, LOC100856189, Del, T_7, FLMSLYYSL, (SEQIDNO:9727); XM_014109384.1, DIS3L, Del, T_7, FLNCENVLKPKASS, (SEQIDNO:9728); XM_536110.5, CFH, Del, T_7, FLNMNLHMSWLQ, (SEQIDNO:9729); XM_014115842.1, BAZ1A, Ins, T_7, FLPDCHLPGDS, (SEQIDNO:9730); XM_849282.4, CLRN3, Ins, T_7, FLPEGPIPAKTGGEKAHGICSKRWNSIL, (SEQIDNO:9731); XM_005618617.2, UGDH, Del, T_7, FLPILTM-PLKKLILYLFL, (SEQIDNO:9732); XM_014115614.1, LOC100688957, Ins, T_7, FLPPDSCGEPHYHHYLIPT-SPPPHPYVLLPQQPLPAGPLLHY, (SEQIDNO:9733); NM_001122645.1, D102, Ins, T_7, FLQLPLPGT1, (SEQIDNO:9734); XM_014108246.1, NR4A1, Ins, T_7, FLQPPYWSQSQPCPEPLEAVPLTGHLPAGGERK-LFHIHGFPGPGAHFSTPRRPRDAGR TGAFGQG-PERGPQWKRGPLCRVWGQRFVPALRRPHLRGL, (SEQIDNO:9735); XM_005639098.2, CNOT6L, Del, T_7, FLQSHVPKSCLSRRESMWMVVQYSSKQKNLHWCK-SIQWNLTKWQWLIQMDPKLC, (SEQIDNO:9736); XM_014112771.1, DNA2, Del, T_7, FLRDLCWWGI-INSFLPWC, (SEQIDNO:9737); XM_005620968.2, WBSCR22, Del, T_7, FLRFTLCWFMEPGPSC-SYTRRTPSSWS, (SEQIDNO:9738); XM_005641854.2, ZNF75D, Del, T_7, FLRKNGNY, (SEQIDNO:9740); XM_014118099.1, NOL8, Del, T_7, FLRMMKDLVVLIYSGEEWEVILAGILGRLEQTTCE-WTVGRNIKMPKGE, (SEQIDNO:9741); XM_003435449.1, LOC100684897, Ins, T_7, FLRYRTWCS, (SEQIDNO:9742); XM_005619828.2, ACAT1, Ins, T_7, FLSALRWYF, (SEQIDNO:9743); XM_003640298.1, LOC100855846, Ins, T_7, FLSFCCSHSPCSHFLSPWSYTQKDAVSEDGWSL, (SEQIDNO:9744); XM_014110308.1, MORC1, Del, T_7, FLSISYHQDLATHLWRILQQVLSWSSAQSR, (SEQIDNO:9745); XM_014109103.1, PAX2, Ins, T_7, FLSLPSRARGCEPARGGVCERPAPARRGEAAHR-GAGPPGRAALRHIPAAARQPRLCQ QNPGQVL, (SEQIDNO:9746); XM_005642111.1, LOC609849, Del, T_7, FLSMGFLRT, (SEQIDNO:9747); XM_014118880.1, LOC482344, Ins, T_7, FLSMSPGCSHPLWLIPQY, (SEQIDNO:9748); XM_534842.3, LOC477647, Ins, T_7, FLSSPTVS, (SEQIDNO:9749); XM_005615356.2, PIGN, Ins, T_7, FLTFIRNRYKWTCSPTNIEGI, (SEQIDNO:9750); XM_538554.3, LVRN, Del, T_7, FLTFYIM-SSVKITPWCLELCP, (SEQIDNO:9751); NM_001003176.1, RPE65, Del, T_7, FLTSEEWRSLTM-PLLTSTQ, (SEQIDNO:9752); XM_014116675.1, AKAP1, Del, T_7, FLVKSMLAVRTDRWRPALWS, (SEQIDNO:9754); XM_005627538.2, FILIP1, Del, T_7, FLVPLSFLP, (SEQIDNO:9755); XM_014111483.1, LOC611979, Del, T_7, FLVSGFLLKSTVW, (SEQIDNO:9756); XM_014109103.1, PAX2, Del, T_7, FLVSPQQGTGV, (SEQIDNO:9757); XM_005625665.2, THADA, Del, T_7, FLVSQNSIPFFSNSWKL, (SEQIDNO:9758); XM_846785.4, BTBD10, Del, T_7, FLVSVCLPWHILK, (SEQIDNO:9759); XM_014120908.1, SERPINGI, Ins, T_7, FLWLCSRIL, (SEQIDNO:9760); XM_541402.3, LOC484287, Ins, T_7, FLWPFKKKPNKRTGRYFVL, (SEQIDNO:9761); XM_014109417.1, LOC100688948, Ins, T_7, FLWSNHVCLYMATPQFPDGQISCSL, (SEQIDNO:9762); XM_546110.4, SLC16A9, Ins, T_7, FLWYCCR-TRMWFTVHGNSDHYVPVF, (SEQIDNO:9763); XM_005639817.2, RTP4, Ins, T_7, FLYL-CKQILGSRKIKI, (SEQIDNO:9764); XM_005615676.2, LOC102154335, Del, T_7, FLY-LKTLLPGHLSLKVELISLERSRSNKRIRGST-FLPTWQNWL, (SEQIDNO:9765); XM_014110864.1, GALNT3, Ins, T_7, FLYNIFDFNAKRSKY-SIFQRGIKDGKKYKQKQDV, (SEQIDNO:9766); XM_535048.6, ACADSB, Ins, T_7, FLYPRDRGISQSRCI-CRVGL, (SEQIDNO:9767); XM_014107795.1, LOC487177, Del, T_7, FMAMKRLVGHLHLMNSQEKLK, (SEQIDNO:9768); XM_005622466.2, SOAT1, Del, T_7, FMCTT-SLKGSAPPCFGISNRSPSALAFWSYVYLTPSCQVC, (SEQIDNO:9769); XM_014122375.1, DNAH12, Del, T_7, FMLLYKRERNLVLLVGIFHTDLMNPTYASVSDNY-SYL, (SEQIDNO:9770); NM_001013852.1, VN1R4, Del, T_7, FMPSHPFVRFVCLF, (SEQIDNO:9773); XM_005634064.2, CCDC168, Del, T_7, FMPVYQQIHWRLYPKLFAGLFPQEL, (SEQIDNO:9774); NM_001031630.1, TERT, Del, T_7, FMSRKPRFKRTDSSSTGRASGASYRA, (SEQIDNO:9776); XM_005622414.2, SHCBP1L, Del, T_7, FMTFFGETGMMKKVVRITLL, (SEQIDNO:9777); XM_005642125.2, FRMD7, Del, T_7, FMWTDH-PRCPDGLQSWQRKMTGQTAVWSPL, (SEQIDNO:9778); XM_005618857.2, SPHAR, Del, T_7, FNALDI-FLKSQNMKEILRLNYFLDLTGRTFDSMSHLW, (SEQIDNO:9779); XM_539875.1, COR9A7, Ins, T_7, FNGCVHYCWFFDPYNHLLHLHHFHHPQDSLSL-WAEESLFYVCVPLHLCRDRVWHL LVPL-CETQANTGSRV, (SEQIDNO:9780); XM_005626598.1, PKD2L2, Ins, T_7, FNKPMYIDFWDGKP-TYVLLKQSYVIFIFGHFCAW, (SEQIDNO:9781); XM_014108769.1, ARHGAP22, Ins, T_7, FNLGKPDCWGKR, (SEQIDNO:9782); XM_005624950.2, MNT, Ins, T_7, FNLQILFCKYFGKH, (SEQIDNO:9783); XM_014119189.1, ABCB4, Ins, T_7, FNPDWSLQCGTGCSMY, (SEQIDNO:9784); XM_014115134.1, TSEN15, Del, T_7, FNRAADGAAILA-LRLPLQPIPGACGAKPWVDS, (SEQIDNO:9785); XM_005638404.2, TRPM7, Ins, T_7, FNRRRSKETT, (SEQIDNO:9786); XM_005642422.1, OVCH1, Ins, T_7, FNSKISTGL, (SEQIDNO:9787); XM_005625561.2, LRIG3, Del, T_7, FPAMYSLICKHLAS, (SEQIDNO:9788); XM_003640168.3, ABT1, Ins, T_7, FPARGRVREA- QEEGSVSLSHGREKAVQVQQGLHRGLGGVPGQASSQACGGQSSQHAHGSPKAQPLPLRPMESQVPAPFHVVPPQRTSCL, (SEQIDNO:9789); XM_014119565.1, LRRC41, Ins, T_7, FPCSTWDH, (SEQIDNO:9790); XM_005627957.1, SECTHRC1, Ins, T_7, FPEQTEGDRGGGGPV, (SEQIDNO:9791); XM_534842.3, LOC477647, Del, T_7, FPFLTYCLLAKFGLFFP, (SEQIDNO:9792); XM_014112679.1, GRM1, Ins, T_7, FPGDLFGDVPSS, (SEQIDNO:9794); XM_014119262.1, SLC6A15, Ins, T_7, FPGTCCGSKNPARKHWCVELHKP, (SEQIDNO:9795); XM_547724.5, SLC7A7, Ins, T_7, FPHGLLALDHLPGGRGTLQGYHQIPHRDWDWPFRVGPLLPQQQGGKKQKNSLGPKNCSIHYMVPPGPMYVSCCRDGFGRWRRDAQATRSQV, (SEQIDNO:9796); XM_014109990.1, SPARCL1, Ins, T_7, FPIHFGNCSCNPDKCKVPV, (SEQIDNO:9798); XM_014109991.1, SPARCLI, Ins, T_7, FPIHFGNCSCNPG, (SEQIDNO:9799); XM_014118880.1, LOC482344, Del, T_7, FPIHVARMFSSFVAYPSVLRKERQ, (SEQIDNO:9800); XM_844651.4, SETD9, Ins, T_7, FPIHWKPNF, (SEQIDNO:9801); XM_005638791.2, LTN1, Del, T_7, FPKASTVCFYLFW, (SEQIDNO:9802); XM_014119702.1, CFAP54, Del, T_7, FPKIHLFPKCWNMKEIRELMLENLPIDSSWIT, (SEQIDNO:9803); XM_005637172.1, LOC611455, Del, T_7, FPLGIVRTTAMKYVNNLLKSWETVVLLKLLIQKSSNSTVQDFSCHFIPL, (SEQIDNO:9804); XM_003434058.3, LOC100684793, Del, T_7, FPLQSVQRQNAFCWQQWLMIAMWPYANH, (SEQIDNO:9805); XM_546110.4, SLC16A9, Del, T_7, FPMVLLSDSDVVYCTRQQ, (SEQIDNO:9807); NM_001284438.1, DEFB126, Ins, T_7, FPPDSLGLRSFIFEKV, (SEQIDNO:9808); NM_001017521.1, cOR52P3, Ins, T_7, FPPGHPRSGTISPVALTPRVLPGHSHNCGQHYHPGCCCH, (SEQIDNO:9809); XM_533692.5, TMEM147, Del, T_7, FPPGKAASMTSSGSS, (SEQIDNO:9810); XM_005630827.2, THEM5, Ins, T_7, FPPIREEVHLSFPTWPLPGGGPRLDPSGLSGCTERPCGKDRGPEALHVLHRPEQGPAD GLCQVLRYLPSAAARRGITPV, (SEQIDNO:9811); XM_845796.3, THEM5, Ins, T_7, FPPIREEVHLSFPTWPLPGGGPRVCTWRLPGYHDGRDFF, (SEQIDNO:9812); XM_005628322.1, SLC30A9, Ins, T_7, FPPRMAEFSDVEKLFTRDLLWASVPSRAESSEVVLHKRAERRTGVADSQSGKSTIVR, (SEQIDNO:9813); XM_005638791.2, LTNI, Ins, T_7, FPRHPQFAFTSFGDCYRRKQRYI, (SEQIDNO:9814); XM_014106286.1, MYCBP2, Del, T_7, FPRKQQCKNKICRSCEEGQAYTR, (SEQIDNO:9815); XM_014119142.1, LSM8, Ins, T_7, FPRLKKPRGNTERV, (SEQIDNO:9816); XM_014106285.1, MYCBP2, Del, T_7, FPRNLKLILMTFSKI, (SEQIDNO:9817); XM_005628579.2, AGMO, Del, T_7, FPSALLSGESEA, (SEQIDNO:9818); XM_014108246.1, NR4A1, Del, T_7, FPSAPLLVPVPALPRAP, (SEQIDNO:9819); XM_005626363.1, TYRP1, Ins, T_7, FPSDLGSIPKRVCHC, (SEQIDNO:9820); XM_847656.3, LOC610217, Del, T_7, FPSSATVLDMYHPMFIFSCLPSICLCRLPLTPLSMV, (SEQIDNO:9822); NM_001005870.1, RXFP2, Ins, T_7, FPSSKQCLEPNPLHSHNQLFQGQVETAAAQTSEENFQN, (SEQIDNO:9823); XM_003433032.1, LOC100688267, Ins, T_7, FPSSWVYRKFPPSSDVL, (SEQIDNO:9824); XM_535467.5, SLC12A1, Ins, T_7, FPSSYWDSCWCQYLRRFGGSPRCHPQRNHAGHFHHHCR-LYRSCYLCRGLCGPRCY RKHE, (SEQIDNO:9825); XM_005638811.2, LOC102153645, Del, T_7, FPSVLISPVSVNLQCIIDLRTVCPVILAHRSTSLMAVSHRTSSPVGIDH, (SEQIDNO:9826); XM_005629214.2, TMTC3, Ins, T_7, FPSWICCC, (SEQIDNO:9827); NM_001013846.1, CCKBR, Ins, T_7, FPVLVATV, (SEQIDNO:9828); XM_014117525.1, NRXN1, Ins, T_7, FPVQDNIPRWTDSI, (SEQIDNO:9830); XM_005640499.2, BOL1, Ins, T_7, FPVWVCKRSEDCK, (SEQIDNO:9831); XM_014116442.1, ABCA5, Ins, T_7, FPVWVINIFCFNADTSF, (SEQIDNO:9832); XM_014113241.1, RAVER2, Del, T_7, FPVYINLCFASLHRMKAVMLVALQ, (SEQIDNO:9833); XM_005617241.1, SLC6A2, Del, T_7, FPWGLDLES, (SEQIDNO:9834); XM_014109139.1, CFAP43, Del, T_7, FQEIVKST, (SEQIDNO:9837); XM_014113264.1, LOC100684019, Del, T_7, FQEQLNMSSKILYMTQKDTRCSSVI, (SEQIDNO:9838); XM_014118218.1, REV3L, Del, T_7, FQIQVLRVVIHLKIACLLNIIHLILIQ, (SEQIDNO:9839); XM_014120726.1, LOC607038, Del, T_7, FQIVHTLKISDMWKNKNQFYTFCTNIQKFIIRKTYNILLIS, (SEQIDNO:9840); XM_014119702.1, CFAP54, Del, T_7, FQKALETKLLHIHFML, (SEQIDNO:9841); XM_014119702.1, CFAP54, Ins, T_7, FQKSTYFRNVGT, (SEQIDNO:9842); XM_003433214.2, LOC100685852, Del, T_7, FQLEEEPLSSAGYSLC, (SEQIDNO:9843); XM_005637157.2, LOC100683403, Del, T_7, FQLLKYWSRTIHP, (SEQIDNO:9844); XM_005642422.1, OVCH1, Del, T_7, FQLQDIHWIIEENWNVLGCSECHQAVWQN, (SEQIDNO:9845); XM_005640284.2, LRP2, Del, T_7, FQLTLVVSTSKKSFLLMIQRI, (SEQIDNO:9846); XM_852855.4, FLRT3, Ins, T_7, FQPSQLNRTVPGTEFPDCCTSKPSRHKPEEALSSR, (SEQIDNO:9847); XM_536110.5, CFH, Del, T_7, FQQSMEIRQHVLM, (SEQIDNO:9848); XM_005619936.2, RNASEK, Ins, T_7, FQRPFRCADRGRSFHRERF, (SEQIDNO:9850); XM_843679.5, SON, Ins, T_7, FQSEYCCSKANSTKKPGNINKRISCVIWISTSKKRSR, (SEQIDNO:9851); XM_014109787.1, DOPEY2, Ins, T_7, FQSFAAKNISPAFDFIVAHNGL, (SEQIDNO:9852); XM_014110705.1, GRB14, Del, T_7, FQSIWCLLQLKPMVKYPPHRFCRCF, (SEQIDNO:9853); XM_005642434.2, LOC100686288, Del, T_7, FQWKNTKEH, (SEQIDNO:9856); XM_014120154.1, FAT1, Del, T_7, FQYILKQVLSQRRQGNWTESSKMNN, (SEQIDNO:9857); XM_005615345.2, VPS4B, Del, T_7, FQYLPLTLSLSG, (SEQIDNO:9858); XM_005641432.1, YIPF6, Del, T_7, FRASVCWVTVYFP, (SEQIDNO:9859); XM_005618243.2, TLR10, Del, T_7, FRAVRKLRF, (SEQIDNO:9860); XM_534289.5, SLC25A36, Del, T_7, FRHCLWLFKKKVMGLFTVV, (SEQIDNO:9861); XM_005628880.2, TMCO2, Del, T_7, FRLCWSAQMGIFSQFKTIISSCPWVCKREF, (SEQIDNO:9862); XM_005635818.2, SP140, Del, T_7, FRRFHIIIILKRFLKT, (SEQIDNO:9863); XM_014112169.1, LOC100856170, Del, T_7, FRSKSLYYSL, (SEQIDNO:9865); XM_005631507.2, ATG2A, Del, T_7, FRSLMPPRMGPSAPVTSTISDRASRGPVPVAMSD, (SEQIDNO:9866); XM_005639030.2, PRMT2, Del, T_7, FRSPSTTTF, (SEQIDNO:9867); XM_005639390.2, LOC487951, Ins, T_7, FRSRLHSDRSSNMVGRLFHDGHSPDAEKKENALHPGL, (SEQIDNO:9868); XM_014116442.1, ABCA5, Ins, T_7, FRSSDFYVFGASLF, (SEQIDNO:9869); XM_533578.4, NLRP9, Del, T_7, FRTLACCGTWRSSKRKNSGNLRSSSNKNLCN- LASSQSHGLS, (SEQIDNO:9870); XM_014118865.1, UTRN, Del, T_7, FRVERQKVTNYITQWWNIVYLQHLGKMYETSQRC, (SEQIDNO:9871); NM_001012395.1, UTRN, Del, T_7, FRVERQKVTNYITQWWNIVYLQHLGKMYETSQRY, (SEQIDNO:9872); XM_014107486.1, LOC100688473, Ins, T_7, FRVSRCHEFQRESEESHLPLGGTFILPLFFKNCFGSCI, (SEQIDNO:9873); XM_005635896.2, LOC100688622, Ins, T_7, FRVSRCHEFQRESVESHLPLRGTFILPLFF, (SEQIDNO:9874); XM_005640282.2, LRP2, Ins, T_7, FRYIKRHDL, (SEQIDNO:9875); XM_005635025.2, RBL1, Ins, T_7, FRYISKSI, (SEQIDNO:9876); XM_014110908.1, LOC100686469, Ins, T_7, FSACLCQPQRIQPNWKAIT, (SEQIDNO:9877); XM_005637170.2, KLRB1, Ins, T_7, FSCFQHLERQSN, (SEQIDNO:9878); XM_014116442.1, ABCA5, Del, T_7, FSCMGYHLYFLL, (SEQIDNO:9879); XM_005639368.1, LOC100856070, Del, T_7, FSCTLDQICLNKGIKISQLLFCLQ, (SEQIDNO:9880); NM_001013846.1, CCKBR, Del, T_7, FSCVGCHCIVPTRGVPSTALVHTAHFQERQSLSSTC, (SEQIDNO:9882); XM_005622962.2, NPHS2, Del, T_7, FSFFPALIPTTRLTFVSKLWRYPFMRL, (SEQIDNO:9885); XM_014108715.1, C27H12orf40, Del, T_7, FSFFSLVKLIILIPWSPN, (SEQIDNO:9886); XM_014121827.1, PTPRS, Del, T_7, FSFLLLSLPWARPCHTSSGCLGPKT, (SEQIDNO:9887); XM_005642072.1, LOC102152098, Del, T_7, FSFPQVKI, (SEQIDNO:9888); XM_005618393.2, BTBD1, Del, T_7, FSFSAPLAIIMALQ, (SEQIDNO:9890); XM_005641779.2, STAG2, Del, T_7, FSFWKVSCMSMQHTLWIACGTVLPSY, (SEQIDNO:9891); XM_014109050.1, R3HCC1L, Del, T_7, FSFYFIWN, (SEQIDNO:9892); XM_014114796.1, LOC612019, Del, T_7, FSFYFRMLMIGMGHQIIMG, (SEQIDNO:9893); XM_848418.4, GPR137C, Ins, T_7, FSGELDLCNVSPRRCPRKSVEMDCVCSSIN, (SEQIDNO:9894); XM_845544.4, C6H7orf61, Del, T_7, FSGNTKLSQPSWNTMTPGKVL, (SEQIDNO:9895); XM_005642434.2, LOC100686288, Ins, T_7, FSGRTPRSIDPVLHF, (SEQIDNO:9896); XM_849291.3, PRPF8, Del, T_7, FSGSQQMRLGT, (SEQIDNO:9897); XM_005642102.1, LOC102156483, Del, T_7, FSIFMGLAGECPLALSAS, (SEQIDNO:9898); XM_005638424.2, FAM214A Ins, T_7, FSIKCLAECFSWCYSTKYSLQNQCC, (SEQIDNO:9899); XM_005626363.1, TYRP1, Del, T_7, FSIRPGLNSQESVPLLRP, (SEQIDNO:9900); XM_542156.5, CHAF1A, Del, T_7, FSKGRCLWWSCRISWLRNLLKPSLQRHLHTRACPLRVRCWSLALKKTLFLATHPGV LPLLPAHLRGSLLPKSSTAVPGPSPPPHLSAE, (SEQIDNO:9901); XM_005641813.2, ARHGAP36, Ins, T_7, FSKRPGRSPRTQSGPQDEDDIDTQSVGAGASEAARDCLPRTRGQTFPL, (SEQIDNO:9902); XM_005639098.2, CNOT6L, Ins, T_7, FSKVTCQNHV, (SEQIDNO:9903); XM_003640055.1, LOC100856122, Del, T_7, FSLCYMSSLCWETFS, (SEQIDNO:9904); XM_534842.3, LOC477647, Ins, T_7, FSLEIYLCS, (SEQIDNO:9905); XM_014107412.1, MICU2, Del, T_7, FSLPLKIKTSIGKM, (SEQIDNO:9906); XM_005639817.2, RTP4, Del, T_7, FSLPLQANTWKQKDQN, (SEQIDNO:9907); XM_014114384.1, TNNI3K, Del, T_7, FSLRCTLQHTMDMNR, (SEQIDNO:9908); XM_005638667.1, LOC487459, Del, T_7, FSLYSMLELS, (SEQIDNO:9910); NM_001164486.1, SELENOI, Ins, T_7, FSMFAIHFVYSMDPSVAFRYFRVAS, (SEQIDNO:9911); XM_014111106.1, ALS2CR11, Del, T_7, FSNIISLIEDNQKKN, (SEQIDNO:9912); NM_001048097.1, PTGFR, Ins, T_7, FSNLHDSGNLVKQPCHCYSHEGLSEI, (SEQIDNO:9913); XM_844651.4, SETD9, Del, T_7, FSNPLETHLFLDAWMGYSLMEMTKEYQKLYTDLAMGGIDLVPSK, (SEQIDNO:9914); XM_547829.5, TMEM260, Del, T_7, FSPFSGFLAHMLEESLLRGCFHFLV, (SEQIDNO:9915); XM_014118577.1, PKHD1L1, Del, T_7, FSPHFSVWMST, (SEQIDNO:9916); XM_014117993.1, LOC100685402, Del, T_7, FSPICLSSTPS, (SEQIDNO:9917); XM_538762.4, LOC481640, Del, T_7, FSPICSSSTPS, (SEQIDNO:9918); NM_001122645.1, DIO2, Del, T_7, FSPTASSWHSMTRSFSSSTWCCC, (SEQIDNO:9919); XM_005630975.2, RELN, Del, T_7, FSQELQLSIAVSQKATLFISTEMKEVSSILPPPGM, (SEQIDNO:9921); XM_014116442.1, ABCA5, Del, T_7, FSQFRFLCFWCIALLKMLWFPSNLFQTYIS, (SEQIDNO:9922); XM_014106710.1, SLC4A7, Del, T_7, FSQHFFC1HSSSNLRLSGIFLPRCDRQSVILLYFSQ, (SEQIDNO:9923); XM_005629214.2, TMTC3, Del, T_7, FSQLDLLLLSEYYMFLAWGSVFW, (SEQIDNO:9924); XM_014118177.1, BVES, Del, T_7, FSQLGWLFQLHFTFI, (SEQIDNO:9925); XM_005626214.1, PMM1, Del, T_7, FSQRQPMRR, (SEQIDNO:9927); XM_014116978.1, DDX31, Del, T_7, FSQVVSWWSSTTTSSSRPCRAAQGPWRQDGHHLPPHN, (SEQIDNO:9928); XM_005633004.2, CATSPERD, Del, T_7, FSREIISEVVSFHFPSLHQ, (SEQIDNO:9929); XM_005623486.2, SYNE2, Del, T_7, FSRNLLLTCC, (SEQIDNO:9930); XM_005627957.1, CTHRC1, Del, T_7, FSRTDRGGQRRWWTCIMECAYKDLQGCLGEMEALGPMAFLVPLGSQVEMDSKEK RGNA, (SEQIDNO:9931); XM_014108700.1, LOC611536, Del, T_7, FSSHFSVLVLLQIVW, (SEQIDNO:9932); XM_014108701.1, LOC611536, Del, T_7, FSSHFSVLVLLQIVWGAGAVAVLLAGEPSSPTAIFLLMTTRPGLRVKGTARVWGLT WPPSAQKLS, (SEQIDNO:9933); XM_014115000.1, MRI, Ins, T_7, FSSHHYNVLLAERAVGSVDGGELHAWALGEKHHISPACI, (SEQIDNO:9934); XM_005635476.2, PDS5B, Del, T_7, FSSILTKMAYW, (SEQIDNO:9935); XM_534154.5, RNF219, Del, T_7, FSSLHLTKK, (SEQIDNO:9936); XM_005626899.2, FKTN, Del, T_7, FSSMKRLTICGMEALRPKQEKNLNTCFPSLHCAGLSL, (SEQIDNO:9937); XM_003640168.3, ABT1, Del, T_7, FSSPRTGS, (SEQIDNO:9938); XM_014115507.1, PIEZO2, Ins, T_7, FSSRDRRTGTRGRSLCQINLPVPIPRNHDQMD, (SEQIDNO:9939); XM_849282.4, CLRN3, Del, T_7, FSSRRPDTSENRRRESPWNLLQEMEFYS, (SEQIDNO:9940); XM_014117525.1, NRXN1, Del, T_7, FSSSRQHP, (SEQIDNO:9941); XM_014111846.1, PRDX4, Del, T_7, FSSTPLISPLCVQLKSSPMELKNSNR, (SEQIDNO:9942); XM_005630827.2, THEM5, Del, T_7, FSTHPRRSPSVFSNLAPTWRGPPA, (SEQIDNO:9944); XM_845796.3, THEM5, Del, T_7, FSTHPRRSPSVFSNLAPTWRGPPGLHMEAPWLP, (SEQIDNO:9945); XM_005615724.2, TJP2, Del, T_7, FSTQTLDKVSKP, (SEQIDNO:9946); XM_005619936.2, RNASEK Del, T_7, FSTSIPLC, (SEQIDNO:9947); XM_541064.5, DSEL, Del, T_7, FSTVVIFSTSEFLQPTSIFLKLNLKLTHLWTPVNGRHLISTVCISVCSEAGCSP, (SEQIDNO:9948); XM_014117497.1, FER1L5, Ins, T_7, FSTYAVQLYLFNTELLGHELDQT, (SEQIDNO:9949); XM_546437.4, COR8C4, Del, T_7, FSVSLPILSAMC, (SEQIDNO:9950); XM_014122259.1, DNAH1, Del, T_7, FSVYLTWPTWTPCTSTPWSGFSTSSAQASP- TRRGQTT, (SEQIDNO:9951); XM_533741.5, SLC6A11, Del, T_7, FSWKQLWDNSRVRVALRVGGK-FALYLKASAMQHK, (SEQIDNO:9952); XM_014119262.1, SLC6A15, Del, T_7, FSWNLL-WVKESGEEALVCGIT, (SEQIDNO:9953); XM_014120569.1, PTGFRN, Del, T_7, FSYRFIDL, (SEQIDNO:9956); XM_005641570.2, ARMCX1, Del, T_7, FSYSKNLECVLRKSRH, (SEQIDNO:9957); XM_014109991.1, SPARCL1, Del, T_7, FSYTFWELQLQSRLKNLLY, (SEQIDNO:9958); XM_014109990.1, SPARCL1, Del, T_7, FSYTFWELQLQSRQMQGSCLIIPNQLLIL, (SEQIDNO:9959); XM_014110047.1, BANK1, Ins, T_7, FTCEKRSNPIISLGELLFLGFGIAEFKLL, (SEQIDNO:9961); XM_005631620.2, MTA2, Del, T_7, FTHWCLTLCRRHF, (SEQIDNO:9962); XM_005640869.2, LOC478984, Del, T_7, FTIILSTTFQQQQVNTMAPTSAGGLSGRKTSLRRL, (SEQIDNO:9963); XM_014121804.1, CACNA1A, Del, T_7, FTKRRGGCVSTSAAWSKLRPSTGLCSVW, (SEQIDNO:9964); XM_014107997.1, KNTC1, Del, T_7, FTLQIFNF, (SEQIDNO:9965); XM_014114799.1, ECT2L, Ins, T_7, FTMLQITIKVCPRLFRKDASGQTGFLYSVT-TLHFSIYLFLPESKRSVCSCTSQLALEVY N, (SEQIDNO:9966); XM_005624150.1, CBX4, Ins, T_7, FTPCPLPFLCKI, (SEQIDNO:9967); XM_005635222.2, LOC477273, Ins, T_7, FTRKQIKFSSGAF, (SEQIDNO:9968); XM_536312.4, CMYA5, Del, T_7, FTRTYMNKQLERKTRKRRQLLKVTV, (SEQIDNO:9969); XM_014114127.1, CCT6A, Del, T_7, FTRVQKR-ERNS, (SEQIDNO:9970); XM_014118383.1, UHRF1BP1, Ins, T_7, FTSCFPDGFPTPSTQYPPSPEA, (SEQIDNO:9971); XM_005629907.2, LEPROTL1, Del, T_7, FTSFHLFHTA, (SEQIDNO:9972); XM_014110652.1, SLC17A2, Del, T_7, FTSHLDKQKSKTGPKRRPLPAF, (SEQIDNO:9973); XM_014111380.1, DNAJC16, Del, T_7, FTSLLTLSGGAPLMRSNCTFHTT, (SEQIDNO:9974); XM_005620301.1, OR16A12, Del, T_7, FTTSSAALSVC-STR, (SEQIDNO:9975); XM_014107594.1, FZD3, Del, T_7, FTVVGKKR, (SEQIDNO:9977); XM_014115681.1, RALGAPA1, Ins, T_7, FTWFAWCHNAYYGFYCSSW, (SEQIDNO:9978); XM_534129.3, LACC1, Ins, T_7, FTWIYYKNRWNILHPNS, (SEQIDNO:9979); XM_003638904.3, LYPLA2, Ins, T_7, FTWTWRHRAQLG, (SEQIDNO:9980); XM_014109945.1, WDFY3, Del, T_7, FTYQNSCSIPT-TLI, (SEQIDNO:9981); XM_014118650.1, CWH43, Ins, T_7, FVAACWCGTIRIRTTT, (SEQIDNO:9982); XM_014118899.1, CASD1, Del, T_7, FVDSSSYRRFKTNQDI, (SEQIDNO:9983); XM_014117404.1, RANBP2, Del, T_7, FVESAVILMRT-MEMGKIFSQNFKKFRTLRNPRMRK, (SEQIDNO:9984); XM_014119043.1, PEX1, Ins, T_7, FVEYQSAAE-DHNTSPSRSYGKRRKQ, (SEQIDNO:9985); XM_005631715.2, RCN1, Ins, T_7, FVFCFFFSKLQEDR, (SEQIDNO:9986); XM_014116451.1, RDM1, Del, T_7, FVFFFFFCP, (SEQIDNO:9987); XM_014108289.1, LOC102156424, Ins, T_7, FVFGCGLMCLLQRWLFVQ, (SEQIDNO:9988); XM_014119604.1, TMPO, Ins, T_7, FVFGLSSYGNQPRKSVQ, (SEQIDNO:9989); XM_003433948.1, LOC100684112, Ins, T_7, FVFHPMHVSVRLAFSPTFN, (SEQIDNO:9990); XM_005619626.2, LOC489325, Ins, T_7, FVFLLFL-NAMC, (SEQIDNO:9991); XM_003433951.2, LOC100684620, Ins, T_7, FVFYYILHSKYARKP-SHCGHYHLRPSLTFTYVFFAGKSFHHRHRCF, (SEQIDNO:9992); XM_544884.5, KCNJ15, Ins, T_7, FVGCSAGHYDPD, (SEQIDNO:9993); XM_005627651.2, MANEA, Del, T_7, FVISSTSCLSQVWAQDI, (SEQIDNO:9994); XM_005638132.2, RAD54B, Ins, T_7, FVKFKSWWCGT, (SEQIDNO:9995); XM_014116854.1, ITGAE, Del, T_7, FVLLSFRWPPLSLSRNWWWVSQRS, (SEQIDNO:9996); XM_848171.2, LOC610635, Del, T_7, FVLVLECTSALLLPRTPTRVQWPQ, (SEQIDNO:9997); XM_848256.3, LOC484896, Del, T_7, FVLVLECTSAP-LLPRAPTRVQLPQ, (SEQIDNO:9998); XM_014110082.1, LOC487944, Del, T_7, FVMFFHYSNSPVLTLISMNC, (SEQIDNO:9999); XM_535270.5, TNPO1, Del, T_7, FVMLLHR-GLTQKMHI, (SEQIDNO:10000); XM_014118893.1, LOC482235, Del, T_7, FVMSLPFSFSHAPTHCYLKG, (SEQIDNO:10001); XM_014110085.1, LOC100687081, Del, T_7, FVNFFHYSNSPVLTLISMNC, (SEQIDNO:10002); XM_014113223.1, DYNC2H1, Ins, T_7, FVNKKPKSLHPTRCSLHHYRG, (SEQIDNO:10003); XM_014109133.1, TDRD1, Del, T_7, FVNSYRVDISSLNFRHPLVSTVVKC1HAQIFIQPMSV-VHDSQRMISGTVPLF, (SEQIDNO:10005); XM_005640538.2, CFLAR, Ins, T_7, FVPGRCCRCC-STYCQGPSGYFK, (SEQIDNO:10006); XM_005640646.2, RQCD1, Ins, T_7, FVPL-FAHCQQNTTL, (SEQIDNO:10007); XM_014112169.1, LOC100856170, Ins, T_7, FVRSHYIIHFKKSLS-GRKTQSPLYLWISHHSYSFIFWAFHLCLP, (SEQIDNO:10008); XM_014111215.1, ZBED6, Del, T_7, FVSTKAL-RIC, (SEQIDNO:10009); XM_014110084.1, LOC100685107, Del, T_7, FVTFFPSIDSLVLTLLSMN, (SEQIDNO:10010); XM_014110202.1, ABHD10, Del, T_7, FVVFCFVVLF, (SEQIDNO:10011); XM_847331.4, CEPT1, Del, T_7, FVVLLGHLCSIVHT-GRRMFLEHCDLE, (SEQIDNO:10012); XM_005621786.2, CEPT1, Del, T_7, FVVLLGHLC-SIVHTGRRMFLEHCDLEYSMLQSPRS, (SEQIDNO:10013); XM_843573.4, DARS, Del, T_7, FWDCTMFVRRQCSPGILNDSLL, (SEQIDNO:10014); XM_014107257.1, ARFGAP1, Ins, T_7, FWESGGHVGQAPGGPELPEQRWGPPPEPHRG-PELLGELREHGPCQGPQVPEQRQLD VRRRL-GREEELGQLGCVGLGLRVQQ, (SEQIDNO:10015); XM_014108734.1, LOC100687078, Del, T_7, FWFLKWSQW, (SEQIDNO:10016); XM_546450.3, OR28D07, Del, T_7, FWGTCLCLT, (SEQIDNO:10017); XM_005627189.2, LOC481728, Del, T_7, FWIMKTMT-FLSMT, (SEQIDNO:10018); XM_847187.3, TXNDC12, Del, T_7, FWIPVARCILKSSMRMETPATSISMSVLSKL-FRG, (SEQIDNO:10019); XM_844183.4, ESRRG, Del, T_7, FWKCWRPRS, (SEQIDNO:10020); XM_014119672.1, OTOGL, Del, T_7, FWKINLHTSFGRQGST, (SEQIDNO:10021); XM_005616941.2, CUL2, Del, T_7, FWKITYGICTRE-FWSLKSKYLLCHGIGRNIAKVQTIWTACI-GISTLSLLKRIN, (SEQIDNO:10022); XM_845265.4, UTS2B, Del, T_7, FWKWCMDGHILPKEMNCFQQK-KIQIARNYCWIY, (SEQIDNO:10023); XM_536500.4, NUP155, Del, T_7, FWLEKMAVYMK, (SEQIDNO:10024); XM_005625825.2, XRCC6, Del, T_7, FWLMVLGPCLNLRVKLN, (SEQIDNO:10025); XM_014111948.1, TSPAN6, Del, T_7, FWLNWSLPS, (SEQIDNO:10026); XM_005632409.2, ASB14, Del, T_7, FWLSALAS, (SEQIDNO:10027); XM_014119539.1, ABCE1, Del, T_7, FWMATFQQKT, (SEQIDNO:10028); XM_014120560.1, PIP5K1A, Del, T_7, FWMLTCTMLCVRPYSVTVWCCRASR, (SEQIDNO:10029); XM_014122642.1, FAT3, Del, T_7, FWMMSMIVPQLSFPVAIV, (SEQIDNO:10030);

XM_014122196.1, DOCK6, Del, T_7, FWQRSQKTPNSSGIITSCGSVSRTSARSVRMPCGRTRP, (SEQIDNO:10031); XM_003640134.2, OTOL1, Del, T_7, FWQSLVWTQ, (SEQIDNO:10032); XM_003639984.3, BTAF1, Del, T_7, FWRRFFHGWEQLMTISNRRVQLKHLHV, (SEQIDNO:10033); XM_014111351.1, DMD, Ins, T_7, FWSSCKRP, (SEQIDNO:10034); XM_005621541.1, CLEC16A, Del, T_7, FWTCLKTNTGA, (SEQIDNO:10035); XM_005638158.1, KIAA1429, Ins, T_7, FWTHTTFRAAASTIAHANNSGY, (SEQIDNO:10036); XM_005628358.2, TRIM58, Del, T_7, FWTMKQVKSPFTM, (SEQIDNO:10037); XM_014106943.1, RIN2, Del, T_7, FWTRKAARRP, (SEQIDNO:10038); XM_848657.4, TRIM38, Del, T_7, FWTVILELYPFTT, (SEQIDNO:10039); XM_539359.3, OR2T2, Del, T_7, FWWLSQPMWS, (SEQIDNO:10040); XM_005631191.1, LOC483467, Del, T_7, FWWWASMTSFLS, (SEQIDNO:10041); XM_005624150.1, CBX4, Del, T_7, FYAVSPPFPLQDITRGNPRRTSWIPGC, (SEQIDNO:10042); XM_014114799.1, ECT2L, Del, T_7, FYDAPNHN, (SEQIDNO:10043); XM_847055.3, LOC609729, Del, T_7, FYFWCTHQL, (SEQIDNO:10044); XM_014108288.1, GXYLT1, Del, T_7, FYGLSMIFGLY, (SEQIDNO:10046); XM_533983.5, CCDC81, Del, T_7, FYHDPFSSNKMWNLLSKELGSL, (SEQIDNO:10047); XM_014120337.1, BIRC6, Del, T_7, FYIMLIEYLSFH, (SEQIDNO:10048); XM_005626134.2, C1OH2orf74, Del, T_7, FYINVPKAKLKRQKKFLV, (SEQIDNO:10050); XM_005635896.2, LOC100688622, Del, T_7, FYIVRICLGTQH, (SEQIDNO:10051); XM_014107486.1, LOC100688473, Del, T_7, FYIVRICMQN, (SEQIDNO:10052); XM_014122769.1, RIC3, Del, T_7, FYIYYIFYLSFQRGKLLQRIGNALLPQLETPTGKLPISSLFNCKKN, (SEQIDNO:10053); XM_005635222.2, LOC477273, Del, T_7, FYKKTDQIFQWCFLNISHRLW, (SEQIDNO:10054); XM_014107218.1, COMMD7, Del, T_7, FYKTCMTF, (SEQIDNO:10055); XM_003432392.1, LOC100687724, Del, T_7, FYLFVDPMK, (SEQIDNO:10056); XM_003640185.3, TMEM237, Del, T_7, FYLIGQAWILVKS, (SEQIDNO:10057); XM_014108759.1, ZFAND4, Del, T_7, FYLPVVLE, (SEQIDNO:10058); XM_003638904.3, LYPLA2, Del, T_7, FYMDLETQGTAGLTPSPPSGSLTSSTSVPMHPGSL, (SEQIDNO:10059); XM_534129.3, LACC1, Del, T_7, FYMDLLQEQVEYLTSQLLVHSISSVVPNGEIPRWWFKKICVGWGMLLDLTWRNFTE, (SEQIDNO:10060); XM_544123.3, TRPA1, Del, T_7, FYPVYLDTAKK, (SEQIDNO:10061); NM_001172235.1, UGCG, Del, T_7, FYRHYGTLL, (SEQIDNO:10062); XM_014116024.1, PCNX, Ins, T_7, FYSTKSLSGKCNIHHFICSTCEILGERL, (SEQIDNO:10063); XM_005627580.2, DOPEY1, Del, T_7, FYTVLGYFLFLQMLPCL, (SEQIDNO:10064); XM_005627466.1, PKHD1, Del, T_7, FYWGTEVPPSFFWLYSTMNFRTPVFS, (SEQIDNO:10065); XM_533381.4, TMX3, Del, T_7, FYWIWLSVKDLYKIWMNRLKIIGKMTFGL, (SEQIDNO:10066); XM_856309.4, KDELR2, Del, T_7, FYYYVQRFFYTKKL, (SEQIDNO:10067); XM_005636644.2, LIPJ, Del, T_7, LAAKTSSLIPHLKDLLVQSCVR, (SEQIDNO:10068); XM_014110801.1, CCDC141, Del, T_7, LAALIRHLMYLGESKLTLSSLNQKV, (SEQIDNO:10069); XM_003434547.1, LOC100687427, Del, T_7, LAFLNAMC, (SEQIDNO:10070); XM_014111151.1, MFN2, Del, T_7, LAGRATGRA1, (SEQIDNO:10071); XM_005626218.2, BAIAP2L2, Del, T_7, LAGTRGGKRKKHET, (SEQIDNO:10072); XM_549283.3, ADGRG4, Del, T_7, LAKLHCLRPEMSQKH, (SEQIDNO:10073); NM_001002952.1, EPB41L5, Ins, T_7, LAQDNQIGF, (SEQIDNO:10075); XM_014119721.1, ENPP1, Ins, T_7, LARIRCGN, (SEQIDNO:10076); XM_005630949.2, BCAP29, Ins, T_7, LASVETSGYPYYSIG, (SEQIDNO:10077); XM_532924.5, SLC30A6, Del, T_7, LASYYRNLDL, (SEQIDNO:10078); XM_005641414.2, AMER1, Del, T-7, LAVSAVTGKARSLGLKKVS, (SEQIDNO:10079); XM_003639076.3, SYCE1L, Del, T_7, LAVVLQGARQLRPRVGKWRASWSP, (SEQIDNO:10080); XM_005630844.1, LRIG2, Del, T_7, LAWITWKN, (SEQIDNO:10081); XM_014122003.1, LOC403903, Del, T_7, LCFLDVWIVSSWL, (SEQIDNO:10082); XM_005642125.2, FRMD7, Ins, T_7, LCGQTTPGAQTVSNHGRGK, (SEQIDNO:10083); NM_001031630.1, TERT, Ins, T_7, LCHGNHVSKEPTLLLPEERLEPVTEHRNQTTLQ, (SEQIDNO:10084); XM_005616820.1, TMC1, Del, T_7, LCILQMCLEDPAGKQWWDRNLCG, (SEQIDNO:10085); XM_014110567.1, ATXN1, Del, T_7, LCLDRAGHLAVQREPASSSTCRAPSSPLGTSASR, (SEQIDNO:10086); XM_005634064.2, CCDC168, Ins, T_7, LCLYTSRFTGDYTPNCSLDYSPKNFKEDKLQSSSGGKDFKFFRYMDFIQKVLGVPLG VLQSS, (SEQIDNO:10087); NM_001013852.1, VN1R4, Ins, T_7, LCPLIHLSDLSVFFKYLKSVDGEHVCILYYVFSFSQPLCAHEL, (SEQIDNO:10088); XM_005615845.2, CARNMT1, Del, T_7, LCSFLPTLYSTDVLKLINISFIPGSISLAITGGQLIRFDPSLSPMLTPTVFLLVTFP, (SEQIDNO:10089); XM_545128.5, SLC15A2, Del, T_7, LCSSRTRCRY, (SEQIDNO:10090); XM_014119192.1, VWDE, Del, T_7, LCTYYSPLRDVWDIVQKLFLMQNYTHVTLMKLKLEVTVFVSC11HCHHHPQEGRKL WWS, (SEQIDNO:10091); XM_005629133.1, LOC100686641, Ins, T_7, LDDFKFLALIYSFLLHHGVLYSGLESCVEGPFCSWTKKSFLYLWVPSGCGFTVLWLS DGHVSEPDI, (SEQIDNO:10092); XM_005625619.2, BEST3, Del, T_7, LDFIGYSSSGEGASTNYCTGNLLSLLFFTRP, (SEQIDNO:10093); XM_014113223.1, DYNC2H1, Del, T_7, LDLSSITLHIEFSKTCILS, (SEQIDNO:10094); XM_536737.4, SLC25A33, Del, T_7, LDLWQLLQFLRDVLPASLIHMKS, (SEQIDNO:10095); XM_003432360.1, LOC100685932, Del, T_7, LDQDSLSICTPALAILWARTR, (SEQIDNO:10096); XM_014118119.1, PHIP, Del, T_7, LDQVSQRKYQNWSSILTKLTVSSFPTLATDL, (SEQIDNO:10097); XM_003435483.1, FOXR2, Ins, T_7, LDSSKWLEKHHPPQSLFPGQL, (SEQIDNO:10098); XM_005637041.2, TM7SF3, Del, T_7, LDTDSGKQNYFS, (SEQIDNO:10099); XM_014112641.1, NWD2, Ins, T_7, LEAGHRTMHGELTGDLRYHSQAREVQSPQYAAIFVNQWCSFHLGYRYNHGHVQHR, (SEQIDNO:10100); XM_014111447.1, VPS13D, Del, T_7, LELVPLTTMQ, (SEQIDNO:10102); XM_531814.5, MSH6, Del, T_7, LEMTLYPMTF, (SEQIDNO:10103); XM_014112077.1, MAN2A1, Ins, T_7, LETELGSGIWHRYFLPHDALLQL, (SEQIDNO:10105); XM_536122.5, RAB3GAP2, Ins, T_7, LEVFAWRKLYRGYVSHSGVSWT, (SEQIDNO:10106); XM_005631218.2, LOC483596, Del, T_7, LEVLKASCLL, (SEQIDNO:10107); XM_848405.1, LOC483573, Del, T_7, LEVLMSSCLL, (SEQIDNO:10108); XM_014116451.1, RDM1, Ins, T_7, LFFFFFFVLKILHVP, (SEQIDNO:10109); XM_544974.4, PKD2, Del, T_7, LFFTMWWKRYWKFVFTSYTISGVSGIVWML, (SE- QIDNO:10110); XM_005633841.2, ALG11, Ins, T_7, LFIIPPWANSLWNFMCMSVRYPLGNQTAATEKERVSINQQKWEEANGGCIFSSILQC RWRRRKSFVVCLKGPAEKV, (SEQIDNO:10111); XM_003433052.3, ALG11, Ins, T_7, LFIIPPWANSLWNFMCMSVRYPLGNQTAATEKERVSINQQKWEEANGGCIFSSILQC RWRRRKSFVVCLKGPAEKVP, (SEQIDNO:10112); XM_014118470.1, POLH, Del, T_7, LFKWNSGKILI, (SEQIDNO:10113); XM_539788.5, FSTL5, Del, T_7, LFLLPHSSSPT, (SEQIDNO:10114); XM_005637418.1, COR8S14, Del, T_7, LFPPSPTHS, (SEQIDNO:10115); XM_846025.3, ADAMTS5, Del, T_7, LFPRSPPKKSTQSPAMPAIKWGRTLHSCSG, (SEQIDNO:10116); XM_537050.5, SLC30A7, Del, T_7, LFSQKELREH, (SEQIDNO:10117); XM_014121504.1, MGAT5, Del, T_7, LFTSVRLKIGVLIYLGEQKIPTKKLIIIHWRKFVRILIFSTA, (SEQIDNO:10118); XM_848171.2, LOC610635, Ins, T_7, LFWSWSVPQLCCSPELPHECSGLSDVHSGHTHAEPLHLQPEEQRHKEGSEKSHWGSS DV, (SEQIDNO:10119); XM_848256.3, LOC484896, Ins, T_7, LFWSWSVPQLRCSPELPLECSCLSDVYSGHTHAKPLHLQPEEQRHKESSEKILWGSS DV, (SEQIDNO:10120); XM_005627622.2, SRSF12, Del, T_7, LGLRTCAVSLVDMAL, (SEQIDNO:10121); XM_005639633.1, ATP13A3, Ins, T_7, LGQAATLV, (SEQIDNO:10122); XM_536257.5, KLB, Ins, T_7, LGRWDWSISSGRELEDRWKRTLYMGSFHPHTP, (SEQIDNO:10123); XM_540672.2, OR16F12, Del, T_7, LGSLQMWSVSCWLSWLMTGM, (SEQIDNO:10124); XM_005641635.2, TBC1D8B, Del, T_7, LGSPKKKP, (SEQIDNO:10126); XM_005621497.2, TMC5, Ins, T_7, LGTRLSQS, (SEQIDNO:10127); XM_014110652.1, SLC17A2, Ins, T_7, LHHIWTSRNPRLGQREDPYPP1, (SEQIDNO:10129); XM_014120096.1, LOC102152484, Ins, T_7, LHHSLCIRYNL, (SEQIDNO:10130); XM_844450.4, LOC486076, Del, T_7, LHLLCHMSLAILWVCGMMKKRVNVQTMCA, (SEQIDNO:10131); XM_014119262.1, SLC6A15, Del, T_7, LHLSWQHWWCLQFWALKQML, (SEQIDNO:10132); XM_005634703.2, LOC606793, Ins, T_7, LHLYCCNQTLEI, (SEQIDNO:10133); XM_014118588.1, CSMD3, Del, T_7, LHLYLQDLDFIFINKGLHPKHSIQDVQFMKITMAKQLLRTPCMTPTQSQWKERQYDL IPT, (SEQIDNO:10134); XM_005629907.2, LEPROTL1, Ins, T_7, LHPFTYSILHSEKISG, (SEQIDNO:10135); XM_005624950.2, MNT, Ins, T_7, LHQNFFNLQILFCKYFGKH, (SEQIDNO:10136); XM_014113358.1, SC5D, Del, T_7, LHRTSIQPHGLRMTSSDKLLVS, (SEQIDNO:10137); XM_014107997.1, KNTC1, Ins, T_7, LHYKSSTFKNSTSD, (SEQIDNO:10138); XM_537465.5, DHRS7, Del, T_7, LIASGLNLLSTQV, (SEQIDNO:10139); XM_014121811.1, LOC102153907, Del, T_7, LIFLDVWTVYS, (SEQIDNO:10140); XM_005630352.2, RMDN2, Del, T_7, LIFNQVGITSLIQMK, (SEQIDNO:10141); XM_005639074.2, ART3, Del, T_7, LIKKVKKLF, (SEQIDNO:10142); XM_005639026.2, MCM3AP, Del, T_7, LITRLQPWPGRRGKACIKTWLSFGTRRK, (SEQIDNO:10144); XM_014118396.1, STK38, Del, T_7, LKALTGNISERDLLQYLLKSKALMIPQTSMNFQNLIFLSQQ, (SEQIDNO:10145); XM_005627278.2, STK38, Del, T_7, LKALTGNISERDLLQYLLKSKALMIPQTSMNFQNLIFLSQQLQVITLRLTTRTKTGSSS ITHTSALRA, (SEQIDNO:10146); XM_547836.5, DAAM1, Del, T_7, LKCSEMKMS, (SEQIDNO:10147); XM_005624898.2, EFCAB5, Del, T_7, LKDWRQKPRKCSRK, (SEQIDNO:10148); XM_003639988.3, MMP21, Del, T_7, LKEINTGDTTVTRIRPTQKMNKETSTPN, (SEQIDNO:10149); XM_014111020.1, INO80D, Del, T_7, LKERMETSFQLPKRPRNLNGPYRL, (SEQIDNO:10150); NM_001011556.1, CLN5, Del, T_7, LKGLMISTGRKMGR, (SEQIDNO:10151); XM_005639064.2, USO1, Del, T_7, LKKAHIFNV, (SEQIDNO:10153); XM_005627752.1, LOC100856021, Del, T_7, LKKTVTLK, (SEQIDNO:10156); XM_003639382.3, DENND4C, Del, T_7, LKLSENFSCLSTNFLCLDHILFPLKSIFHTSCKTSLFLHHKDQESLYSFQSMMH, (SEQIDNO:10157); XM_005623314.2, ARHGAP5, Del, T_7, LKMRLSRN, (SEQIDNO:10158); XM_014109787.1, DOPEY2, Del, T_7, LKNIPRIF, (SEQIDNO:10159); XM_005626455.2, CSNK1G3, Del, T_7, LKNQTMTT, (SEQIDNO:10160); XM_535470.5, COPS2, Del, T_7, LKPSRIMMNREVQDEPLA, (SEQIDNO:10161); XM_005627773.1, SH3BGRL2, Del, T_7, LKQRKATQSIHS, (SEQIDNO:10162); XM_539791.4, TLL1, Del, T_7, LKRKTSVPSRTAGAASSAA, (SEQIDNO:10163); NM_001171748.1, RBM12, Del, T_7, LKSWILWKIVFILLMDPMGKQLVKAL, (SEQIDNO:10164); XM_014112366.1, MPHOSPH10, Del, T_7, LKTLILMKMKENCLEVKNLSQVKVPETSNTKTSLIQLKVMKT, (SEQIDNO:10165); XM_014112702.1, ADGB, Del, T_7, LKTLKERLNYHHH, (SEQIDNO:10166); XM_005623082.2, ANKRD12, Del, T_7, LKVMRLKICF, (SEQIDNO:10167); XM_014110041.1, PAPSS1, Del, T_7, LKYLLMLLCMFVNRGMSKDSTKKHGLEKLKASLVSILSMKNQKLLNWC, (SEQIDNO:10168); NM_001289066.1, MME, Del, T_7, LLARMIRTL, (SEQIDNO:10169); XM_847415.3, CLPX, Del, T_7, LLCYLKQTQRKA, (SEQIDNO:10170); XM_544475.5, NUDC, Del, T_7, LLEEKRGWQRSSSHRPSTTITSWHRRPDGRRELGRRLSGGRRPRGQPGWPKRPNQRP LGPRSRS, (SEQIDNO:10172); XM_847331.4, CEPT1, Ins, T_7, LLFCWDNVLLCTLADVCFW'NIAIWNN, (SEQIDNO:10173); XM_014110202.1, ABHD10, Ins, T_7, LLFFVLLFCFRIGGFHLMLKKALLFPNYILPKRI, (SEQIDNO:10174); XM_003434558.1, LOC100686309, Del, T_7, LLFLNAMC, (SEQIDNO:10175); XM_014113716.1, ALG6, Ins, T_7, LLFTWQVF, (SEQIDNO:10176); XM_014118473.1, MRPL14, Del, T_7, LLGSGAPSLMQAEHSASAVSAPIGASVQFRR, (SEQIDNO:10177); XM_005617468.2, BDP1, Del, T_7, LLICFRKFLLKKRKENKNLLKIRA, (SEQIDNO:10178); XM_532271.4, NT5DC1, Del, T_7, LLIQCRDWKTQKTHWSTPGLVRESVLTAQSQFQVLKQ, (SEQIDNO:10179); XM_535002.5, NT5C2, Del, T_7, LLIVLDIPAVKQDLKMGTSSCLTEVCSRM, (SEQIDNO:10180); XM_014119240.1, LOC106559724, Del, T_7, LLIVLDIPAVKQDLKMGTSSCLTEVCSRV, (SEQIDNO:10181); XM_005630079.2, EIF2AK2, Del, T_7, LLKNLNSVRSTERYLSIMNCLRKDLHIT, (SEQIDNO:10182); XM_014120611.1, AP4B1, Ins, T_7, LLLGAPLHQVAEGGGAV, (SEQIDNO:10183); XM_005621973.2, CLCA4, Del, T_7, LLLMKPRITASLMPLEPLHQETLIFPNSLFSLKVRD, (SEQIDNO:10184); XM_014109476.1, STARD9, Del, T_7, LLLRTNIFFHLLAQKYVNLKIKLEF, (SEQIDNO:10185); XM_532299.5, DCAF13, Del, T_7, LLLVMTKL, (SEQIDNO:10186); XM_849440.4, CYP2R1, Del, T_7, LLMLLKHTKVDLLTLNN, (SEQIDNO:10187); XM_014113265.1, LOC100684019, Del, T_7, LLMNSWLGSLRTQITKQW, (SEQIDNO:10188); XM_005634400.2, METTL6, Del, T_7, LLMN- SWLGSLRTQVTKKW, (SEQIDNO:10189); XM_532373.5, LNX1, Del, T_7, LLNPLSKEHQHTMTEELDAETFFWLSMVEVHQE, (SEQIDNO:10190); XM_014115910.1, CNIH1, Ins, T_7, LLPIRHDLCFGELL, (SEQIDNO:10191); XM_014117160.1, APOF, Ins, T_7, LLPPAAPCGCHFTWKLDKHSLIFEILDTFLRLLVLPDSAPKVPAWLHLHGSSAQVPG GLATGDCPGESWLPG, (SEQIDNO:10192); NM_001003126.C RPGR, Del, T_7, LLPSVRLSSFLLDLILQLH, (SEQIDNO:10193); XM_546085.4, PCNXL2, Ins, T_7, LLQFSDCILHNNQIGQLSPTPHV, (SEQIDNO:10194); XM_005626107.2, PSME4, Del, T_7, LLRISTMMQL, (SEQIDNO:10195); XM_014110190.1, SENP5, Del, T_7, LLRQSPVWLLKMLVLCPLK, (SEQIDNO:10196); XM_005627566.2, BCKDHB, Del, T_7, LLTAQESRWLYPEALSRPRDFFCHA, (SEQIDNO: 10197); XM_005624315.2, BRCA1, Del, T_7, LLTIQVLVSLKSASTLAFEEKK, (SEQIDNO:10198); XM_014112077.1, MAN2A1, Del, T_7, LLTLTEMIITGVATLHPDPFTNEWIGYWNPI, (SEQIDNO:10199); XM_014109945.1, WDFY3, Ins, T_7, LLTRIPVFQQL, (SEQIDNO:10200); XM_014111411.1, LOC611589, Del, T_7, LLVFTPQHFWKM, (SEQIDNO:10201); XM_014107594.1, FZD3, Del, T_7, LLWLAVFGG, (SEQIDNO:10202); XM_538213.3, LOC481092, Del, T_7, LLYFLGQQNFTSWLLCPMTAMLPYANPCIT, (SEQIDNO:10204); NM_001313886.1, LOC100683286, Del, T_7, LLYFLGQQSFISWLLCPMTAMLPYANPCII, (SEQIDNO:10205); XM_014116993.1, NUP214, Del, T_7, LMFAHFQMRLNSKNAHLPIISF, (SEQIDNO:10207); XM_532688.5, GATB, Del, T_7, LMHLCLELSRFSTGGA, (SEQIDNO:10208); XM_003640123.2, OSBPLL1, Del, T_7, LMLDIPNYNQ, (SEQIDNO:10209); XM_014112420.1, TICRR, Del, T_7, LMLWILYYIRFTIHLKIQLPALLLFQSGPNRSLAALIPGMQLLWRSGFLPPTLVVPVQ V, (SEQIDNO:10210); XM_005621512.2, SMG1, Del, T_7, LMMIITGRC, (SEQIDNO:10211); XM_014115004.1, TPR, Del, T_7, LMMKTELFQVLQLLWFHIVLMDLLKQFIPHKLLVFLDSGLGHLKICHKQVQVTLILA NLLLKEA, (SEQIDNO:10212); XM_014108770.1, VSTM4, Del, T_7, LMMSGPGGQWHLMSMRLSHG, (SEQIDNO:10213); XM_014109752.1, ROBO1, Del, T_7, LMNFKEQIVKLNLPKP, (SEQIDNO:10214); XM_005615683.2, LOC102155259, Del, T_7, LMNSPSWSSQESQEITQFVRKNSAVI, (SEQIDNO: 10215); XM_005619718.1, TMPRSS4, Del, T_7, LMRSSFQPPHSGSSDGALRSRMEERCPTPCYRHLSSSLTTLGAMQRTHTRGKSPK, (SEQIDNO:10216); XM_014109091.1, KIF20B, Del, T_7, LMVKGKYA, (SEQIDNO:10217); XM_005619074.1, SAMD8, Del, T_7, LNAMLMVQYLMNIVGHFQNQQ, (SEQIDNO:10218); XM_014115839.1, BAZ1A, Del, T_7, LNEPFCATVLCGVVL, (SEQIDNO:10219); XM_005637939.2, SGK3, Del, T_7, LNHSAGLILYKRGFHHHLILMWQDQMISGTLMQRLQKKQFRILCVYLLTIL, (SEQIDNO:10220); XM_005628968.1, ZMYM6, Del, T_7, LNKNLLKWNVKIVL, (SEQIDNO:10221); XM_863015.4, NLK, Del, T_7, LNMIMYSLPLTYSNLHTLTILKKYMLSQN, (SEQIDNO:10222); XM_536271.5, ZCCHC4, Del, T_7, LNPEFVSFFQASACWITR, (SEQIDNO:10223); XM_859089.4, LOC608729, Del, T_7, LNSMRKLK, (SEQIDNO:10224); XM_005640494.1, SF3B1, Del, T_7, LNTSGNTEWLWTEEITDS, (SEQIDNO:10225); XM_014118520.1, LRP12, Ins, T_7, LPARKFSL, (SEQIDNO:10226); XM_005626675.1, KLHL9, Del, T_7, LPATLTVRWCCKASTSSE, (SEQIDNO:10227); XM_014111483.1, LOC611979, Del, T_7, LPAVSRLFIFLCMRFITS, (SEQIDNO:10228); XM_014109770.1, LOC100856716, Del, T_7, LPCGNLIEAP, (SEQIDNO:10229); XM_014119949.1, TBXAS1, Ins, T_7, LPGFLGKPNGAQKAIWTSVWVLSWSPDVYCYL, (SEQIDNO: 10230); XM_005625788.2, ARFGAP3, Del, T_7, LPLMFLLR, (SEQIDNO:10232); XM_532487.2, ITGB8, Del, T_7, LPPHLSACKTAGRVQPRSFGRPGCF, (SEQIDNO:10233); XM_549080.1, CDX4, Del, T_7, LPPYLLFIDFSLLRYSRS, (SEQIDNO:10234); XM_843302.3, COR6C33, Del, T_7, LPSFWGQLNFIF, (SEQIDNO:10235); XM_014122642.1, FAT3, Del, T_7, LPSIPKQV, (SEQIDNO:10236); XM_014109908.1, ANK2, Del, T_7, LPSKKTDFLSLSRYVIRLRNLAGDYHL, (SEQIDNO:10237); XM_005626092.1, LHCGR, Del, T_7, LPSQLPSKCPSSQ, (SEQIDNO: 10238); XM_014112649.1, RBPJ, Ins, T_7, LPSSLCVSYGQWMEEKKRTNGTGWLF, (SEQIDNO: 10239); XM_014109096.1, GFRA1, Del, TJ7, LPTANLSQGLPAAV, (SEQIDNO:10240); XM_014107852.1, EP400, Del, T_7, LPTSLAMKATGVLILWL, (SEQIDNO:10241); XM_014109446.1, PIGB, Ins, T_7, LPVKLLVHMVLLYQNSYKHHGNCSYYNCSFLLSFGRFKVYEQCQVLLPGGTCLHNS SHSSHSMDTFGLQTFLARTKKA, (SEQIDNO:10242); XM_014118274.1, MED23, Del, T_7, LQALIQFRELGVKTYFRPS, (SEQIDNO:10243); XM_846518.4, C4BPB, Ins, T_7, LQCLSGVERPRSHMSVGPLSCPCAGEW, (SEQIDNO:10244); XM_014109884.1, EGF, Del, T_7, LQCPFLGIRSSIQHGKRRQFG, (SEQIDNO:10245); XM_014114127.1, CCT6A, Ins, T_7, LQECRRERETRKS, (SEQIDNO: 10246); XM_848323.4, EYS, Del, T_7, LQHWMSSNLSWRRNITELLPST, (SEQIDNO:10248); XM_014118114.1, SENP6, Del, T_7, LQKFHLKKPIADLLPVQEPMKRASKEVVCKKKTKLKMCPLNLKYNLKTNKNSSFLM MMKKLERIIPSSWAL, (SEQIDNO:10249); XM_014110829.1, METTL8, Del, T_7, LQKGKSTICSARLG, (SEQIDNO:10250); XM_533782.4, DENND6A, Del, T_7, LQKHSSTGHTLFE, (SEQIDNO: 10251); XM_538482.4, MSH2, Del, T_7, LQKIFIRT, (SEQIDNO:10252); XM_005635695.2, DOCKS, Del, T_7, LQKSTCRSTPKTRRRLSC, (SEQIDNO:10253); XM_005630848.2, SLC16A1, Del, T_7, LQLLLLQMECVIC, (SEQIDNO:10254); XM_014121460.1, SLC35F5, Del, T_7, LQMLKVTLLLAQQIRL, (SEQIDNO:10255); XM_014117483.1, LIPT1, Del, T_7, LQPKKSMIECRI, (SEQIDNO:10256); XM_005635381.2, PARP4, Del, T_7, LQQKIMKHQNF, (SEQIDNO:10257); XM_005631134.2, HIPK3, Ins, T_7, LQRNRDFSFWLEIKDTRRT, (SEQIDNO:10258); XM_014117454.1, ARHGAP25, Ins, T_7, LQRYGCAHSGLPVKALPPRPPRASGSLEPVRGVPAMWAAHECG, (SEQIDNO:10259); XM_005625977.2, RANBP2, Ins, T_7, LQSCKIVSF, (SEQIDNO:10260); XM_014118505.1, ADGRF2, Ins, T_7, LQSKEMAQDH, (SEQIDNO:10261); XM_005618200.2, LOC479005, Del, T_7, LQVRTVEIMRR, (SEQIDNO:10262); XM_014109072.1, OBFC1, Ins, T_7, LQWASNKAGRDLGNCNWKERKRCFLQLWSG, (SEQIDNO: 10263); XM_014106313.1, DOCK9, Del, T_7, LQYLKSAYTSSSTWGSDI, (SEQIDNO:10264); XM_005636642.2, RNLS, Del, T_7, LQYVKVTL, (SEQIDNO:10265); XM_005641660.1, NXT2, Del, T_7, LRC- CLLVSSRSIC, (SEQIDNO:10266); XM_005623940.2, TDRD9, Del, T_7, LRCLLGSILMDTGTK, (SEQIDNO:10267); XM_014113993.1, CENPN, Del, T_7, LRCLLSSSRSNRA, (SEQIDNO:10268); XM_014108707.1, PTPRO, Del, T_7, LREKQYLITGCQEYVIVILLFSWYLKQLLIKVLLWSTVASVMNPNSIELPLIHLEISRF VL, (SEQIDNO:10269); XM_014112476.1, CEMIP, Del, T_7, LRGAGVTVESLFMSSTPKQRQSSILTGLTPIDP, (SEQIDNO:10270); XM_014109535.1, CSNK1G1, Del, T_7, LRGKGRRLPSATS, (SEQIDNO:10271); NM_001003359.1, CAMP, Del, T_7, LRIFSPGRRSP, (SEQIDNO:10272); XM_014107454.1, UGT1A6, Del, T_7, LRKAHNAPVPFLMFLDLSPCCQMP, (SEQIDNO:10273); XM_014106997.1, GPCPD1, Del, T_7, LRKISVNM, (SEQIDNO:10274); XM_014114836.1, EVI5, Del, T_7, LRKKIALDRRFYLM, (SEQIDNO:10275); XM_014118151.1, ANKRD6, Del, T_7, LRLFLPRWKSGMKGRLKKLEAKPVRKPSKTRPP, (SEQIDNO:10276); XM_005630852.2, LOC100686848, Del, T_7, LRLLLLQMECVIC, (SEQIDNO:10277); XM_014120310.1, FAM228B, Del, T_7, LRLPFHHFVTL, (SEQIDNO:10278); XM_005622856.2, RIT2, Del, T_7, LRPLRPSDSALMMPFMVS, (SEQIDNO:10279); XM_005633843.2, SERPINE3, Del, T_7, LRRIGHSSFS, (SEQIDNO:10280); XM_014110499.1, GMDS, Ins, T_7, LRSPRHSPQAMV, (SEQIDNO:10281); XM_005637412.1, LOC100683250, Del, T_7, LRTTSAASRLSWMGSIWRRTSCRER, (SEQIDNO:10282); XM_014110866.1, NR4A2, Del, T_7, LSARYKKTQNTCV, (SEQIDNO:10283); XM_005631925.2, MGAT4D, Ins, T_7, LSKHITSHTVN, (SEQIDNO:10284); XM_005626903.2, IKBKAP, Del, T_7, LSMTLRLLQISHHLQYMMNFYC, (SEQIDNO:10285); XM_014120533.1, PLB1, Ins, T_7, LSPPQRLGCPA, (SEQIDNO:10287); XM_005618818.2, SPRTN, Del, T_7, LSRKSKYKVVEMIQSGVHILQLQLRIPAVHPARTGWSIVLFVRMKCWSLRLMSTWT GALKVVASKSKV, (SEQIDNO:10288); XM_003435516.2, LOC100688842, Del, T_7, LSRLTENVLKSLLRHQ, (SEQIDNO:10289); XM_536337.5, LYST, Ins, T_7, LSSRVLSQP, (SEQIDNO:10290); XM_005616833.2, LOC100685462, Del, T_7, LSSVFLWKECHRPELQIQADLSQRFILAICVSQWRKTSCTWLNTKELTLA, (SEQIDNO:10291); XM_003432377.1, LOC100685331, Del, T_7, LSSWGPLNVSFSPQWPMIAMLLSVILCITQWLCPQDSAVPSSLGPI, (SEQIDNO:10292); NM_001025269.1, HACD1, Del, T_7, LSSYILSGLLVNSLQYMLPYHM, (SEQIDNO:10293); XM_014109133.1, TDRD1, Ins, T_7, LSTATEWT, (SEQIDNO:10294); XM_542919.5, SLC4A11, Del, T_7, LSTSTSRCSPARLLRVTRLAAVGSYTPPAST, (SEQIDNO:10295); XM_014120191.1, NEIL3, Del, T_7, LSVLLRRQSSAIFSSGQKTDQE, (SEQIDNO:10296); XM_014112256.1, WDR41, Del, T_7, LTCGDLDE, (SEQIDNO:10297); XM_014112364.1, FAN1, Del, T_7, LTMHHLLNLPALFVVKWCQGMT, (SEQIDNO:10298); XM_005620205.2, DNAJC6, Del, T_7, LTNREMDVVLTVMY, (SEQIDNO:10299); XM_536312.4, Clv1YA5, Del, T_7, LTPSRRTVVKMRKG, (SEQIDNO:10300); NM_001003081.1, ABCC2, Del, T_7, LTQHPQVGL, (SEQIDNO:10301); XM_534842.3, LOC477647, Del, T_7, LTSFIIQKQDPCFLLFLPI, (SEQIDNO:10302); XM_014117490.1, VWA3B, Del, T_7, LTSLLTAPFAMLMGSLM, (SEQIDNO:10303); XM_014117620.1, ZNF879, Del, T_7, LTSSWGKPT, (SEQIDNO:10304); NM_001286853.1, RWDD4, Del, T_7, LTTPYHRL, (SEQIDNO:10305); XM_014106801.1, LOC610614, Del, T_7, LTVQEEGDPMFISI, (SEQIDNO:10306); XM_005635727.1, NUDT18, Ins, T_7, LVEGDGGRPTKPALTEASGIIGRPSQQI, (SEQIDNO:10307); XM_005638437.1, NEDD4, Del, T_7, LVEIYLLTAPPIEVCQTGILLHVTFFQEVQVPFLLSRMTWSMD, (SEQIDNO:10308); XM_845745.2, TRIM4, Ins, T_7, LVESISIFSHPSSDWWEM, (SEQIDNO:10309); XM_003434546.1, LOC100687264, Del, T_7, LVFLKLMC, (SEQIDNO:10310); XM_540715.3, OR08D06, Del, T_7, LVLLRLSSLQ, (SEQIDNO:10311); NM_001003198.1, PLA2G7, Del, T_7, LVLVNILEHPGLWAKY, (SEQIDNO:10312); XM_848492.2, OR10H12, Del, T_7, LVPLRSSSWWPWPMTDMQPSADPFTIWSS, (SEQIDNO:10313); XM_005634821.2, PANK2, Del, T_7, LVSAVFLLAVPLLKKLLKWHLVEIAPKWIN, (SEQIDNO:10314); XM_005627533.2, SLC17A5, Del, T_7, LVSSFSMHYV, (SEQIDNO:10315); XM_014116529.1, NAGS, Del, T_7, LVVGRCWELLSQPLMPAMVASSQWRPTCYSGAWSRAAFPSCAPSGRRPHAVRCSST RWR, (SEQIDNO:10316); XM_847748.2, LOC483503, Del, T_7, LVVLLRSVFLVSL, (SEQIDNO:10317); XM_014118082.1, DST, Del, T_7, LVVNFISQKTWQI, (SEQIDNO:10318); XM_534250.5, PP2D1, Del, T_7, LVYLMDIMVPQQQT, (SEQIDNO:10319); XM_014121999.1, LOC100685490, Del, T_7, LWFLEAWTLSSLL, (SEQIDNO:10320); XM_005628406.2, SMO, Del, T_7, LWGALAGWPSLWTALAGRLSAVQMAP, (SEQIDNO:10321); XM_014117196.1, LOC106559354, Del, T_7, LWILMQNSLNLPIRKERVSGISLKKMYLL, (SEQIDNO:10323); XM_846595.3, NDNF, Del, T_7, LWLKKTILHYQSQ, (SEQIDNO:10324); XM_005638321.2, UBR1, Del, T_7, LWRWNTKNSLLWNL, (SEQIDNO:10326); XM_005632588.1, PFKFB4, Del, T_7, LWSPSVWILRS, (SEQIDNO:10327); XM_014118899.1, CASD1, Ins, T_7, LWTPHLIVDSRQIKTL, (SEQIDNO:10328); NM_001003167.1, CE9, Ins, T_7, LYDDRLLADSDRLYAVQTNFWL, (SEQIDNO:10329); XM_014114561.1, LOC479816, Ins, T_7, LYHYYLFDMCFILCQDFQ, (SEQIDNO:10330); XM_003432842.1, LOC100686724, Ins, T_7, LYKFRSVP, (SEQIDNO:10331); XM_014121800.1, LOC106560098, Ins, T_7, LYKPRSIP, (SEQIDNO:10332); XM_539577.5, ZMPSTE24, Del, T_7, LYMPGCSH, (SEQIDNO:10333); XM_548259.5, PEX12, Del, T_7, LYNNFDTS, (SEQIDNO:10334); XM_005624915.2, GEMIN4, Ins, T_7, LYPGILSRSAHHGHAPPRGVRAAVCLGLGNPHLL, (SEQIDNO:10335); XM_542001.5, OR10A12, Del, T_7, LYSLLSQTSLSSV, (SEQIDNO:10336); XM_014109438.1, MYO9A, Ins, T_7, LYSPTRPTENKFPTRYKYPEKQAIRR, (SEQIDNO:10337); XM_849878.4, ZDHHC14, Ins, T_7, LYVYFISVFSDSLYICIRYHPRHSSFTTDRIPQCS, (SEQIDNO:10338); XM_014113785.1, ZCCHC2, Ins, T_7, SASDSLCKRTGA, (SEQIDNO:10339); XM_005633637.2, TRIM66, Ins, T_7, SAVLFYRAIQDGQELLRVQGEEGSAYPVHLLQPLAVQLMHRGAPAWPRPWGPTLSA GPQGTTRSEQWFWGLRLVLSSTHTGSAQAILRDL, (SEQIDNO:10340); XM_014122375.1, DNAH12, Ins, T_7, SCSCTREKEIWSSWLEYSIRI, (SEQIDNO:10341); XM_545477.5, KCNJ3, Ins, T_7, SCYLLRRRVL, (SEQIDNO:10342); XM_005633800.2, LOC485325, Ins, T_7, SDGHPRFRGKPALDSIATVCPLCPCCNGQCHHHLHHLD, (SEQIDNO:10343); XM_005633799.2, LOC610911, Ins, T_7, SDGHPRFRGKPALDSIATVCPLCPCCNGQCHRHLHHLD, (SEQIDNO:10344); XM_005630347.2, CEBPZ, Ins, T_7, SDLYQEKRY, (SE- QIDNO:10345); XM_534289.5, SLC25A36, Ins, T_7, SDTVFGCSRRRLWVSLPWSNNSSGETDSKHSHY-DGHL, (SEQIDNO:10346); XM_005641432.1, YIPF6, Ins, T_7, SEPLCAGLLYTSLDSG-NAGLPVGAFGRARTSQLHGPTFCCDCDVCLVYSS-LYSFSC, (SEQIDNO:10347); XM_005625258.2, SH3GLB2, Ins, T_7, SFAIEPQCDSGTRLPFSAE-GQKALE, (SEQIDNO:10348); XM_005628880.2, TMCO2, Ins, T_7, SGFAGQPRWESSPNSRQ, (SEQIDNO: 10349); XM_014106943.1, RIN2, Ins, T_7, SGR-GRQREDLDRRPASPGPGAP, (SEQIDNO:10350); XM_005626285.2, CNOT6, Ins, T_7, SGRTERTWL, (SEQIDNO:10351); XM_541064.5, DSEL, Ins, T_7, SGSFRSFYEGIVHSKGPSGMDLFNAVQ, (SEQIDNO: 10352); XM_533692.5, TMEM147, Ins, T_7, SHLGRRHL, (SEQIDNO:10353); XM_005638811.2, LOC102153645, Ins, T_7, SHQFLSLQFLSTFNAS, (SEQIDNO:10354); XM_014109050.1, R3HCC1L, Ins, T_7, SHSILFGTDI-VFLFFGGYFRNYKLHA, (SEQIDNO:10355); XM_014108759.1, ZFAND4, Ins, T_7, SICPWYWNEWK, (SEQIDNO:10356); XM_005627466.1, PKHD1, Ins, T_7, SIGEQKYLQASFGCILP, (SEQIDNO:10357); XM_862279.4, G3BP1, Ins, T_7, SKLWECGGATH, (SEQIDNO:10358); XM_014119702.1, CFAP54, Ins, T_7, SKRLWRPSCCTYISCFKWQKYLQL, (SEQIDNO: 10359); XM_005635055.2, RALGAPB, Ins, T_7, SLCH-CAGSRNVWKTCLGTTTLPFTQRSKSKSEAFCT, (SEQIDNO:10360); XM_003638951.1, LOC100856766, Ins, T_7, SLQFLHLRNLIHNSMHSQILVQYNNWRQHYYV, (SEQIDNO:10361); XM_533564.5, HIATLi, Ins, T_7, SLSQTGHRFWIC, (SEQIDNO:10362); XM_005642102.1, LOC102156483, Ins, T_7, SLYSWGWQGSVHWHCPPLE-CLPGHHHQPQELQVGSA, (SEQIDNO:10363); XM_014106286.1, MYCBP2, Ins, T_7, SPGSNNAR-TRYAVLARRARHIQGSEDGTFRSQHQKLP, (SEQIDNO:10364); XM_014111818.1, LOC100683280, Ins, T_7, SPQFLHLRNLIHNSMHSQILVQYNNWRQHYYV, (SEQIDNO:10365); NM_001197142.1, CALCR, Ins, T_7, SPVHDGMQLFLDAL, (SEQIDNO:10366); NM_001287163.1, HIF1A, Ins, T_7, SQNEVYPN, (SEQIDNO:10368); XM_535696.4, ENPEP, Ins, T_7, SQNKPRSYWVLSCKL, (SEQIDNO:10369); XM_014119705.1, GRB14, Ins, T_7, SRAYGVFCN, (SEQIDNO:10370); XM_014108367.1, LOC611565, Ins, T_7, SRLPEATLLP, (SEQIDNO:10371); XM_014119270.1, LOC102151283, Ins, T_7, SRSKNSHCPTL, (SEQIDNO:10372); XM_014110987.1, FN1, Ins, T_7, SSIL-YSWLLRQWETLSDKPTMGAHLPGKCLGLYLLR-REPRL, (SEQIDNO:10373); XM_849728.3, MYCT1, Ins, T_7, SSVYSISCGYYG, (SEQIDNO:10374); XM_845820.3, USP50, Ins, T_7, STRHTDLE, (SEQIDNO:10375); XM_005636667.2, LIPN, Ins, T_7, STSEFRNQEI-FRYQRFLSKHGEGTFHQNLQQ, (SEQIDNO:10376); XM_014115134.1, TSEN15, Ins, T_7, STVQQMEQPFWP, (SEQIDNO:10377); XM_005631726.1, LOC100684610, Ins, T_7, SVFPVLHR, (SEQIDNO:10378); XM_014109449.1, ZNF106, Ins, T_7, SWR-TRKSLEQTHYRRESWVLYNQIAKFMSSCFKRE, (SEQIDNO:10379); XM_014115269.1, DNAH14, Ins, T_7, SWSNIFNSKSNCLGESNNCNTTVGLTTMASSEK-ENHTVL, (SEQIDNO:10380); XM_533782.4, DENND6A, Ins, T_7, SYCAQTNSTRVF, (SEQIDNO:10381); XM_843248.3, CCDC54, Ins, T_7, WFLKRRNN-STI, (SEQIDNO:10382); XM_005627533.2, SLC17A5, Ins, T_7, WFLRSLCITCESECCISGYGRFKYNFSR, (SEQIDNO:10383); XM_540672.2, OR16F12, Ins, T_7, WGL-CRCGVSHVGCHGL, (SEQIDNO:10384); XM_534200.5, ACSS1, Ins, T_7, WHCPSAHGREGKGRGGW, (SEQIDNO:10385); XM_014117864.1, PLGRKT, Ins, T_7, WHCSHLFNSWGNKKEEASLPLPYYSIKLYLHLPV, (SEQIDNO:10386); XM_014118119.1, PHIP, Ins, T_7, WIRSARENIRIGVPY, (SEQIDNO:10387); XM_003432360.1, LOC100685932, Ins, T_7, WIRTLCLY-APQHWQFCGPGQDSISLLYSGDPDVESSNLQSE-EQGNQRCP, (SEQIDNO:10388); XM_005623379.1, SOS2, Ins, T_7, WNIFNKYSEN, (SEQIDNO:10390); XM_014111447.1, VPS13D, Ins, T_7, WNWFHCRQPCNEGAA, (SEQIDNO:10391); XM_005641236.2, CFAP47, Ins, T_7, WRK-SYLRFDRFYSDSKKKFTWFL, (SEQIDNO:10393); XM_005634821.2, PANK2, Ins, T_7, WSLLSSYWLYHF, (SEQIDNO:10394); XM_014113223.1, DYNC2H1, Ins, T_7, WTCLQLLYI, (SEQIDNO:10395); XM_005637041.2, TM7SF3, Ins, T_7, WTQILEN-RIIFHRFYLHGILLLHTDYKTDTY, (SEQIDNO: 10396); XM_536737.4, SLC25A33, Ins, T_7, WTYGSCCNF, (SEQIDNO:10397); XM_014118530.1, NIPAL2, Ins, T_7, WVFSVVPWCVFGHKKSRKGTSATVLH, (SEQIDNO: 10398); XM_014116529.1, NAGS, Ins, T_7, WWWVGAGSC, (SEQIDNO:10399); XM_005615845.2, CARNMT1, Ins, T_7, YALFFQLCTQQMF, (SEQIDNO: 10400); XM_540640.3, LOC483521, Ins, T_7, YCH-GDYRILHAGCNGL, (SEQIDNO:10401); XM_005629350.1, ARFIPi, Ins, T_7, YCQCEHFGE, (SEQIDNO:10402); XM_003432856.3, LOC100684808, Ins, T_7, YDFCRDGWFPPDRDGL, (SEQIDNO:10403); XM_014106493.1, TTC21A, Ins, T_7, YDSRAGGGEGA VLQRRSHQLRTGLEVQSSCQPRYWLQARFQL-LEGQEICGRH, (SEQIDNO:10404); XM_014110792.1, CALCR1, Ins, T_7, YDSRRSRIRGEH, (SEQIDNO: 10405); XM_005638321.2, UBR1, Ins, T_7, YGDGIQKIL-CYGICEVL, (SEQIDNO:10406); XM_014121999.1, LOC100685490, Ins, T_7, YGFWRHGHFPPYCDGL, (SEQIDNO:10407); NM_001025269.1, HACD1, Ins, T_7, YHLISCRGCW, (SEQIDNO:10408); XM_539577.5, ZMP-STE24, Ins, T_7, YICLAVHISCFSGACHDLC, (SEQIDNO:10409); XM_014119262.1, SLC6A15, Ins, T_7, YICPGNTGGVCSSGL, (SEQIDNO:10410); XM_538482.4, MSH2, Ins, T_7, YKRYLSGLEPVIER-QKGRTGE, (SEQIDNO:10412); XM_005618818.2, SPRTN, Ins, T_7, YQERASTKWWK, (SEQIDNO:10414); XM_014111483.1, LOC611979, Ins, T_7, YQQFHGCLSFYVCGSLLLDQTSNHWHCKHH-FILWVHDGYGPDFLPFHRDDWIFFLF LVSY, (SEQIDNO:10415); XM_005626675.1, KLHL9, Ins, T_7, YQQHSQFGGAARLRPAQSRRLAL, (SEQIDNO:10416); XM_014119016.1, LOC106559695, Ins, T_7, YQRQPKVRAVQSST, (SEQIDNO:10417); XM_005636091.2, PIWIL1, Ins, T_7, YREPGSE-KWQCFSHTL, (SEQIDNO:10418); XM_005635695.2, DOCK5, Ins, T_7, YRKVLAGAPRRPGED, (SEQIDNO: 10419); XM_539788.5, FSTL5, Ins, T_7, YSCYHTHHHPHKVWNSSQR, (SEQIDNO:10420); XM_544974.4, PKD2, Ins, T_7, YSLLCGGRDIGNSYS-QATLFQEFLELSGCCDHCAVSGRYRN, (SEQIDNO: 10421); XM_542001.5, OR10A12, Ins, T_7, YTLC-CLRLLCPQCDGL, (SEQIDNO:10422); XM_014113358.1, SC5D, Ins, T_7, YTVHLSSLMV, (SEQIDNO:10423); XM_014107594.1, FZD3, Ins, T_7, YYGWQCLVGNSYHHMVLGSCAKVG, (SEQIDNO: 10424); XM_005640422.1, AOX4, Ins, T_8, CEWKKGHREEC, (SEQIDNO:10426); XM_005619365.2, MROH2B, Ins, T_8, CGRNKKEHD- FIPSPPLGS, (SEQIDNO:10427); XM_005637524.2, SLC16A12, Ins, T_8, CGVPVVLHSGLCTNSLDPFHCRLCDHALCSTWECCQ, (SEQIDNO:10428); XM_005637525.1, SLC16A12, Ins, T_8, CGVPVVLHSGLCTNSLDPFHCRLCDHALWSWICAVLLSSYCHGWQVFQQTESSRLWDCHVGKWHWHLHIGSCGSTPY, (SEQIDNO:10429); XM_534660.5, VPS33A, Ins, T_8, CQTQARTNGYNC, (SEQIDNO:10431); XM_005631724.1, LOC100683738, Ins, T_8, CSLHFHVC, (SEQIDNO:10432); XM_014112004.1, LOC106558487, Ins, T_8, CSLHLHVC, (SEQIDNO:10433); XM_535242.6, PLK2, Ins, T_8, FAGLHSRQTLF, (SEQIDNO:10434); XM_005630997.2, PHTF2, Ins, T_8, FALCSRKNL, (SEQIDNO:10435); XM_005623425.2, FBXO34, Ins, T_8, FATGSTPVGLFPVE, (SEQIDNO:10436); XM_003639076.3, SYCEIL, Del, T_8, FCFVFLAVVLQGARQLRPRVGKWRASWSP, (SEQIDNO:10437); XM_005635599.2, UGT1A6, Del, T_8, FCGTFHVI, (SEQIDNO:10438); XM_005623425.2, FBXO34, Del, T_8, FCHRVNASRAVPS, (SEQIDNO:10439); XM_535242.6, PLK2, Del, T_8, FCRASLQTDSLLAVVIQFQISTCQARLRISLRKQLLLFLVAKKTKQDILTHIIECLKKMKKFTSLGMI, (SEQIDNO:10440); XM_005627752.1, LOC100856021, Ins, T_8, FCSCYYSGSRQRSSQSHPI, (SEQIDNO:10441); XM_005631219.2, LOC483600, Ins, T_8, FDHLCGHGVWQHAHCGHYHLQSHAGFPHVLFPGQLVLY, (SEQIDNO:10442); XM_014106743.1, XRN1, Ins, T_8, FEEKWGSSIPAKQSWRKHDVRNFSECRIR, (SEQIDNO:10443); XM_005638410.2, DMXL2, Ins, T_8, FELCDVQFSMGPSR, (SEQIDNO:10444); XM_014106798.1, SCN11A, Ins, T_8, FERLWERPDSRIRF, (SEQIDNO:10445); XM_005618433.2, MORF4L1, Ins, T_8, FFFFFFFFFYSYR, (SEQIDNO:10446); XM_537979.5, PHEX, Del, T_8, FGEQNILDL, (SEQIDNO:10448); XM_853830.5, GABRA2, Del, T_8, FGKNGKMNG, (SEQIDNO:10450); XM_848093.2, LOC610566, Ins, T_8, FHCVWMPGQFTPDRDGL, (SEQIDNO:10451); XM_546489.5, DPAGT1, Ins, T_8, FHHLGIALP, (SEQIDNO:10452); XM_844785.5, HMGCS2, Del, T_8, FHLECPRMLLQDPPWRSWCLVCQTCQNVSPPGSVCPLRSSQK, (SEQIDNO:10453); XM_014109153.1, KNDC1, Ins, T_8, FHQNFKPPVSAQLQFASLAKLLGGRAPAASGVPGQVLQGGARSMAVQK, (SEQIDNO:10454); XM_014111407.1, DOCK11, Ins, T_8, FICCGPFDFSRFKS, (SEQIDNO:10455); XM_005625919.2, APOL6, Del, T_8, FIFFSFTEAHL, (SEQIDNO:10456); NM_001145496.1, TAS2R42, Ins, T_8, FILEQEDHKVYHVGRLCLSFKPLTNFDSGKQQAETDSLEGTVAS, (SEQIDNO:10457); XM_005625919.2, APOL6, Ins, T_8, FILFYFLFSFFFFFLFFFLSPKLIL, (SEQIDNO:10458); XM_005621511.2, SMG1, Del, T_8, FILIAKLAKTG, (SEQIDNO:10459); XM_014111215.1, ZBED6, Del, T_8, FILILSTSQELCVTYVKEV, (SEQIDNO:10460); XM_014119746.1, DDX60, Ins, T_8, FIQLRRCRKKGCKLEVFPVAKASNAKASQS, (SEQIDNO:10461); XM_005639946.1, ATP11B, Del, T_8, FIRMCALSHPNFYISSTVCFLNKHCMTACT, (SEQIDNO:10462); XM_003434870.3, MEIOB, Ins, T_8, FITQSKGRIEN, (SEQIDNO:10463); XM_014114821.1, ABCD3, Ins, T_8, FKTHTDSENHGP, (SEQIDNO:10464); XM_546033.5, TMEM161B, Ins, T_8, FLCESNGSLDCDRKLSGIWT, (SEQIDNO:10465); XM_003639666.1, LOC100856789, Ins, T_8, FLCQHGSH, (SEQIDNO:10466); XM_014121896.1, LOC106560121, Ins, T_8, FLCVWMPGQFTPDRDGL, (SEQIDNO:10467); XM_542650.5, GPR18, Ins, T_8, FLDSPVHHDWVLLNHHS, (SEQIDNO:10468); XM_014109163.1, CNGB3, Del, T_8, FLEFLCSPA, (SEQIDNO:10469); XM_005618433.2, MORF4L1, Del, T_8, FLFFFFFFFFLLLQVSEYCAFMGLFFMKQSV, (SEQIDNO:10470); XM_005634584.2, MBNL1, Del, T_8, FLFFLSFSFSFFFPIVW, (SEQIDNO:10471); XM_847870.2, LOC610378, Ins, T_8, FLFHSQIWILYSIIHTYHPVQPLPTGSTFLQSSCLWGEDQTHPRESSKNVPLQRPGL, (SEQIDNO:10472); NM_001003040.2, RP1, Del, T_8, FLGLYTDLRFVLIILLNFSVLGK, (SEQIDNO:10473); XM_005628231.2, THEGL, Del, T_8, FLGRESEIFLGLKNNGEPQIEDCFGGIKILFALSPILL, (SEQIDNO:10474); XM_005617430.2, IPO11, Del, T_8, FLHFLMRWHINLIRRWTSFWEI, (SEQIDNO:10475); XM_535555.4, GBE1, Del, T_8, FLKILNIMSVPFLFWCTFRAEWASSCRMWICPT, (SEQIDNO:10476); XM_005635688.1, PPP2R2A, Del, T_8, FLKSSPRFPM, (SEQIDNO:10478); XM_005622402.2, RGS1L, Del, T_8, FLKWRSFVPGRQPALTSSTGARHTRIKNLLLSPWLSTLFGVEETTPS, (SEQIDNO:10479); XM_005622401.1, RGS1L, Del, T_8, FLKWRSLMIW, (SEQIDNO:10480); XM_014113248.1, LOC100686868, Ins, T_8, FLLLFLCLF, (SEQIDNO:10481); XM_005627752.1, LOC100856021, Del, T_8, FLQLLLLWIQTALIPISSYLRIENKFL, (SEQIDNO:10482); XM_014107422.1, LOC606856, Ins, T_8, FLRCSSSSICRRDSTIFF, (SEQIDNO:10483); XM_014109416.1, KATNBL1, Del, T_8, FLRFLRIMKQWHRFCSAGI, (SEQIDNO:10484); XM_852029.5, HNRNPH1, Del, T_8, FLTAKFKMGLKVFVSSTPEKADRVARLLLNLNQKMKSNWP, (SEQIDNO:10485); XM_545235.4, TMEM41A, Ins, T_8, FLTVFETFPHDTKLVLEPLGSDSEHPDCAVLLLCSARSDPVQFYLCADRLHPVNSDLSGCSFLLGNGLQAFGHCLGGLSSWNPH, (SEQIDNO:10486); XM_005638907.2, TTC3, Del, T_8, FLVMEPLLRSLILAS, (SEQIDNO:10487); XM_014110076.1, LOC100684714, Ins, T_8, FLYNWCNHRMFSAGNNGI, (SEQIDNO:10488); XM_014113145.1, SPEF2, Del, T_8, FMALTTLGQNFSMHIISVRLMPRLH, (SEQIDNO:10489); XM_541240.4, SAMD3, Ins, T_8, FMETSSQRSL, (SEQIDNO:10490); XM_005628829.2, TLR2, Del, T_8, FPCGVLNIWTYLITSYLTYHPPGSGPFLH, (SEQIDNO:10491); XM_847870.2, LOC610378, Del, T_8, FPFSLTDLDLIFHHTYISPCPTFTYWFHLSSILLSMG, (SEQIDNO:10492); XM_847631.3, COR6M4, Ins, T_8, FPGDSGVYPPGSDVL, (SEQIDNO:10493); XM_014122716.1, PLEKHA7, Ins, T_8, FPGEIADTEGSLED, (SEQIDNO:10494); XM_014115682.1, TTC6, Ins, T_8, FPKKICII, (SEQIDNO:10495); XM_542656.5, FGF14, Del, T_8, FPKWAFWPSRSAGRDLRIPSSRV, (SEQIDNO:10496); XM_003639706.3, RIF1, Del, T_8, FPNMQIHLSLLFMIALLRLEKMLLM, (SEQIDNO:10497); XM_858691.4, OSBPL3, Del, T_8, FPNRSATIHLSLHVMLSLEILFSGKM, (SEQIDNO:10498); XM_847080.1, LOC483451, Ins, T_8, FPPCWRGGCIFFVSDGIGSICGHLQAPALCDHYE, (SEQIDNO:10499); XM_005624332.2, TRPV1, Ins, T_8, FPRDSIFPAEAAIAEDLVCGQLQ, (SEQIDNO:10500); XM_005640932.2, KCTD3, Ins, T_8, FQFAEWKNFNTSR, (SEQIDNO:10501); XM_005638410.2, DMXL2, Del, T_8, FQIHKYRSTKIQILIAGLFYI, (SEQIDNO:10502); XM_005620874.1, CCDC79, Del, T_8, FQIHLHYVQI, (SEQIDNO:10503); XM_005621973.2, CLCA4, Ins, T_8, FQKCINTNS, (SEQIDNO:10504); XM_846828.3, LOC609558, Del, T_8, FQPCYLLFT, (SEQIDNO:10505); XM_005633892.2, LRRC63, Del, T_8, FQRIFLVE, (SEQIDNO:10506); XM_847239.5, MMP17, Ins, T_8, FQRKVLLAADPGWAPGVTAAGTDAPL-LAGPAAAAGQRGRCVRAHQ, (SEQIDNO:10507); XM_542656.5, FGF14, Ins, T_8, FQSGLFGPQEAQVEIS-GSPAQGYSDQVILQARLLLANAPRWSSRWNQG, (SEQIDNO:10508); XM_850372.4, C4H5orf22, Del, T_8, FQSRIPSKKCSLRKSTKSYKSCTSLKSLVPT, (SEQIDNO:10509); XM_003639706.3, RIF1, Ins, T_8, FQTCKYTYHCCS, (SEQIDNO:10510); XM_544113.5, PREX2, Del, T_8, FRMRKWKDQI, (SEQIDNO:10511); XM_014119371.1, DCLK2, Ins, T_8, FRRHACKNHL, (SEQIDNO:10512); XM_014110313.1, TRIO, Ins, T_8, FRRVGEVP, (SEQIDNO:10513); XM_858691.4, OSBPL3, Ins, T_8, FRTGQPPSTYLCMSC, (SEQIDNO:10514); XM_014111692.1, DDX26B, Ins, T_8, FRTIYFNYHHRWKQVNKYCWCSRRASSSFEFSSARK, (SEQIDNO:10515); XM_005638410.2, DMXL2, Ins, T_8, FRYTNTGAPRSKFL, (SEQIDNO:10516); XM_014115196.1, FMO2, Del, T_8, FSASMVLIHQH, (SEQIDNO:10517); XM_014116303.1, LOC106557537, Del, T_8, FSDIGYLTLPFCLDPYIKRPRKPPMAP, (SEQIDNO:10518); XM_005624332.2, TRPV1, Del, T_8, FSEGFNISCRGGHR, (SEQIDNO:10519); NM_001024633.1, HTR2B, Del, T_8, FSFCLCGVP-FLLQM, (SEQIDNO:10520); XM_014116439.1, ABCA6, Del, T_8, FSFQCFYFCM, (SEQIDNO:10522); XM_005617468.2, BDP1, Ins, T_8, FSHQHGRN, (SEQIDNO:10523); XM_847239.5, MMP17, Del, T_8, FSKESTSGG, (SEQIDNO:10524); XM_005627788.2, KIAA1919, Del, T_8, FSLCFLRKAQGRRKPKHLLR-GLEELNTTMPFFASFFCSSFSTLEPR, (SEQIDNO:10525); XM_848093.2, LOC610566, Del, T_8, FSLCLDAWTNS, (SEQIDNO:10526); XM_014110076.1, LOC100684714, Del, T_8, FSLQLVQPQNVFCWQQWH-MIAMWPYASLYFIQ, (SEQIDNO:10527); XM_005626210.1, PKDREJ, Ins, T_8, FSLRFRRGLRH-LARKGLLREKRVQSAQLCFKMHNRAH-RAFLPEELLGHWHNPVLLV EP, (SEQIDNO:10528); XM_003639666.1, LOC100856789, Del, T_8, FSL-SAWVSLSASF, (SEQIDNO:10529); XM_846828.3, LOC609558, Ins, T_8, FSMSFLLRVYTRRQICIT-FLHNSFHILCLWTESHICTSNICVSNPCFSC-STVTDTSITSGP QPSQTAASCFASHTAT, (SEQIDNO:10530); XM_536172.5, TARSL2, Del, T_8, FSMISVLEAAFFFPEEPSFIIHLWISYER-SITDVTSQKCSLPTCSTANSGKPQATGSITAR TCLPLILKRILLLLSP, (SEQIDNO:10531); XM_859725.4, WAP1, Del, T_8, FSPPTENMKQVSK, (SEQIDNO:10532); XM_003639813.3, LPAR6, Del, T_8, FSPPTFRRTIPQQPALKNFQKPHGKHISQGL, (SEQIDNO:10533); XM_546489.5, DPAGT1, Del, T_8, FSPPWDCSTITGTHHRCLWEIPSVTLLA, (SEQIDNO:10534); XM_850372.4, C4H5orf22, Ins, T_8, FSQESLQRNVHSGRVQNLTRVVPV, (SEQIDNO:10535); XM_014112871.1, IPCEF1, Del, T_8, FSQLRM-HRK, (SEQIDNO:10536); XM_014122716.1, PLEKHA7, Del, T_8, FSRRNRRYRRISGGLKMSLQA, (SEQIDNO:10537); XM_014107422.1, LOC606856, Del, T_8, FSSMFFFEYM, (SEQIDNO:10538); XM_014113248.1, LOC100686868, Del, T_8, FSSVSLSFLNPISCQR-WHMTAMSPSVNHCCTRSPCLLRCVYSS-CWVFMGWGCLGL, (SEQIDNO:10539); XM_847080.1, LOC483451, Del, T_8, FSTLLEGWMYFLCQ, (SEQIDNO:10540); XM_84763 1.3, COR6M4, Del, T_8, FSWGQWSLSSWQ, (SEQIDNO:10541); XM_014115742.1, ZNF566, Del, T_8, FSWNQDVR-PRNYF, (SEQIDNO:10542); XM_005626919.1, LUC100856036, Del, T_8, FSWRVFLDTRS, (SEQIDNO:10543); XM_014118505.1, ADGRF2, Del, T_8, FTSLCFSGCLPRHSLSSMES, (SEQIDNO:10546); XM_014119817.1, GALNTL5, Ins, T_8, FTTAWSEIC-CLWQH, (SEQIDNO:10547); XM_003435094.2, HOMEZ, Ins, T_8, FTVPVGTA, (SEQIDNO:10548); XM_005634570.2, P2RY14, Ins, T_8, FVDLFLHCY-HEENLQVPP, (SEQIDNO:10549); XM_005634758.2, DSTN, Ins, T_8, FVGTRTSSSEK, (SEQIDNO:10550); XM_005638125.2, TMEM67, Del, T_8, FWRSWDSRT, (SEQIDNO:10551); NM_001003040.2, RPI, Ins, T_8, FWVYTQISGLSL, (SEQIDNO:10553); NM_001145496.1, TAS2R42, Del, T_8, FYFGTRR-SQSLSCWPFMSFLQATH, (SEQIDNO:10554); XM_005625919.2, APOL6, Del, T_8, FYFILFFIL-FLFLFFIFFSFTEAHL, (SEQIDNO:10555); XM_541240.4, SAMD3, Del, T_8, FYGNELSKIAL-NMFGDP, (SEQIDNO:10556); XM_003434870.3, MEIOB, Del, T_8, FYHTEQGAD, (SEQIDNO:10557); XM_003435094.2, HOMEZ, Del, T_8, FYSASGHGVRI-TIN, (SEQIDNO:10558); XM_005622224.2, GRM7, Del, T_8, LALLSQRKSSTYKLPHLQSP, (SEQIDNO:10559); XM_014111169.1, LOC610561, Del, T_8, LAMWPSC-TYASLPPTPYSGIQSLLWPLQFCLPSSTPSFIA, (SEQIDNO:10560); XM_014111131.1, ABCA12, Del, T_8, LASIPLFPCQWCTFFPRKSLMIRL, (SEQIDNO:10561); XM_014119240.1, LOC106559724, Del, T_8, LATLRNCSALLMILHSLPGDLFLIHYMEIF, (SEQIDNO:10562); XM_005638158.1, KIAA1429, Del, T_8, LCRNMKQQIC, (SEQIDNO:10563); XM_005624333.2, TRPV1, Del, T_8, LCSHCSCWGPWCCTSAT-TRSTWPLWCSPWPWAGPTCSTTPAASSRWASMLL, (SEQIDNO:10564); XM_003434545.2, LOC100687027, Del, T_8, LDQQHSCILNILLLDLWSREKFLQC-SILMWDPCSIP, (SEQIDNO:10565); XM_005629703.2, PAXIP1, Del, T_8, LESLRVSPRCRPQTGAPCGLCSLST-GATASCTSTRNAHIWLFQNQKGRNTNAR, (SEQIDNO:10566); XM_005625919.2, APOL6, Ins, T_8, LFF-FLSPKLIL, (SEQIDNO:10567); XM_014112004.1, LOC106558487, Del, T_8, LFPAFACMLDLFLTCPLISL, (SEQIDNO:10568); XM_005631724.1, LOC100683738, Del, T_8, LFPAFSCMLDLFLTCPLIS1, (SEQIDNO:10569); XM_005634571.2, GPR171, Ins, T_8, LFSFPCWNYWERICNLGFRTKQDKSQVCE-HILDQFADSRFPAHPGITSENRCRPGSGT LEAE-DLPLPSDSLPHVH, (SEQIDNO:10570); XM_005623887.2, JAG2, Del, T_8, LGGPAGRRGCPSHT-GAPGWRIVTAATAWTATGTAARCGVAISLACW-PAGPNP, (SEQIDNO:10571); XM_537979.5, PHEX, Ins, T_8, LGNRISSISELWSYRSNCWT, (SEQIDNO:10572); XM_014118895.1, TMEM243, Del, T_8, LKRRYANAL-GIVTIPSLLLLFLLLSS, (SEQIDNO:10573); XM_005641803.2, SLC25A14, Del, T_8, LLHTSSSRGFKS, (SEQIDNO:10574); NM_001003247.1, KCNB2, Del, T_8, LLRIDv1PMLSSPVSQRRFGGPPSP, (SEQIDNO:10576); XM_005632123.2, NR2C2, Del, T_8, LLVSLAMCR, (SEQIDNO:10577); XM_005627906.2, ATAD2, Del, T_8, LMKSMVWLQYDQAG-KIRFTVPLFPPC, (SEQIDNO:10578); XM_547466.4, FMO4, Del, T_8, LNWCEINRLEFPLI, (SEQIDNO:10579); XM_014118505.1, ADGRF2, Ins, T_8, LPLCVFL-DACQGTPYPLWNPDCFPYGAQISTGGSSLFGWLRGP-SAHCCCHGCCHGA QKGLPTA, (SEQIDNO:10580); XM_549109.5, RPS6KA6, Del, T_8, LQMLTGIDYIEEKFNLLSNLLLENQMIL-FVLILSLLQKHLKILLVCQLVLTLINSSKDS ALLQRLLQRNIKSLLSQVQMCYQLFR, (SEQIDNO: 10581); XM_014112065.1, LOC491446, Del, T_8, LRIL-SIYPRETQR, (SEQIDNO:10582); XM_014109046.1, CSGALNACT2, Del, T_8, LRRQTLWNIDM, (SEQIDNO: 10584); XM_005641091.2, LOC102152866, Ins, T_8, LSPEILPKHHRKSGCSGN, (SEQIDNO:10585); XM_533302.6, EXOSC9, Del, T_8, LTLNSLRWLLQLLN-LAGSQISW, (SEQIDNO:10587); NM_001003232.1, CANX, Del, T_8, LTTLLFVGIEE, (SEQIDNO:10588); XM_005628742.2, TMEM168, Del, T_8, LVFLQQRF, (SEQIDNO:10589); XM_014109446.1, PIGB, Del, T_8, LVNGPWFSITF, (SEQIDNO:10590); XM_014115783.1, ZNF793, Ins, T_8, LWESLH-SEVTPQRTSKNTYWRETLCVQ, (SEQIDNO:10591); XM_005637524.2, SLC16A12, Del, T_8, LWSSSRTSL-RIMHKQLGSIPL, (SEQIDNO:10592); XM_548761.3, COR52AB3, Ins, T_8, SELSIPAV, (SEQIDNO:10593); NM_001024633.1, HTR2B, Ins, T_8, SLFAY-VVSLFYYKCNFSFV, (SEQIDNO:10594); XM_014116439.1, ABCA6, Ins, T_8, SLFNAFIFVCSK-LNGNLYHKRNCVCFGYIHARLCSFTCLPNICDI-LYFSQDEKK, (SEQIDNO:10595); XM_005620874.1, CCDC79, Ins, T_8, SRSNIMFRYNR, (SEQIDNO:10597); XM_003639813.3, LPAR6, Ins, T_8, SVHPHSGEQFHSSLL, (SEQIDNO:10598); XM_005623887.2, JAG2, Ins, T_8, WEALLVAGVALR-TRELLGGGL, (SEQIDNO:10599); XM_005632224.2, GRM7, Ins, T_8, WHCSVSGKALHTNYHTYNLHEPK-CISGSGDAIHAESVHHHFPP, (SEQIDNO:10600); XM_014111131.1, ABCA12, Ins, T_8, WHQFHCFLVSGVLSFQGKA, (SEQIDNO:10601); XM_003434545.2, LOC100687027, Ins, T_8, WISSIHVS, (SEQIDNO:10602); XM_014119240.1, LOC106559724, Ins, T_8, WLPSGTAQLCL, (SEQIDNO:10603); XM_005629703.2, PAXIP1, Ins, T_8, WNHCVSLPGVVHRQERLVGFAHFLRGRL-PAAPQQEMHTSGCSRTKRGEIRMRVKES KYQNCYP, (SEQIDNO:10604); XM_014111169.1, LOC610561, Ins, T_8, WQCGPHVPTLLCHLLLI-LGYSHCSGLCSFVSLLQPHHL, (SEQIDNO:10605); XM_846475.4, NDST3, Ins, T_8, WQQLKLLVAQAHL-HRCCFLLVRKEADTVLGQVHSCGYR, (SEQIDNO: 10606); XM_014109446.1, PIGB, Ins, T_8, WSMDLGSV, (SEQIDNO:10607); XM_005633659.2, TMEM41B, Ins, T_8, YWDFSRCCTSLFCSN, (SEQIDNO:10609); XM_005632123.2, NR2C2, Ins, T_8, YWSH-WQCVDRQHNPLHPQDGDSRV, (SEQIDNO:10610); XM_005641803.2, SLC25A 14, Ins, T_8, YYI-RAAQEASNL, (SEQIDNO:10611); XM_847748.2, LOC483503, Ins, T_9, CGLNKSIAAPGCSLCDIS-LGLSCYSSGKCGDDHPHLVGSPTPHTYVLFS, (SEQIDNO:10612); XM_005620886.2, ADAMTS18, Ins, T_9, CNVRQSERRNSLLPKQTRCLY, (SEQIDNO:10613); XM_849368.3, DPY19L4, Ins, T_9, FAIDTVFFITFLY-FSVNYLFSFYDASYF, (SEQIDNO:10614); XM_014110417.1, SLITRK3, Ins, T_9, FCCLCCCRPLCL-CAATAPEEAAL, (SEQIDNO:10615); XM_849037.4, TSPAN18, Del, T_9, FCSSSSSSWRSSRRPSWPSSSG-KISLASPSPRSSPSTTRATMTQTSSPPPGTPS, (SEQIDNO:10617); XM_547308.5, LPAR3, Ins, T_9, FEFSSHRSSDQKQKVSFPLLLPVG, (SEQIDNO:10618); XM_536488.5, C6, Ins, T_9, FEKRSGTQVYH, (SEQIDNO:10619); XM_005627395.2, XPO5, Ins, T_9, FGKCDQPDVSDIR, (SEQIDNO:10620); XM_014120987.1, LOC100684857, Ins, T_9, FGRKHN-FLLFMCHTGSFLHDLHH, (SEQIDNO:10621); XM_014110073.1, GABRR3, Del, T_9, FIS-DITGKMRGSPFLAQQTKA, (SEQIDNO:10622); XM_003435295.1, SLFN5, Del, T_9, FLEA-GLWTLVYQRSRE, (SEQIDNO:10623); XM_014111218.1, ZC3H11A, Ins, T_9, FLFYMYQR, (SEQIDNO:10624); XM_014110515.1, ZNF165, Del, T_9, FLGFQSMHMDKRYSGERWYLLDQYL-VSTCSQWTPMPFMVLQHPFFWTVIRKVKT MDLCQSWTFVKKLNHKEFYQEEFQD-SCRKDLLSLKTSVSLQAG, (SEQIDNO:10625); XM_005635440.2, EXOSC8, Ins, T_9, FLPASRV-SKDCGTSGVLQEIFERELPS, (SEQIDNO:10626); XM_005625919.2, APOL6, Ins, T_9, FLSPKLIL, (SEQIDNO:10627); XM_014118398.1, KCTD20, Ins, T_9, FLVKQTVQDSESKHERSSWQ, (SEQIDNO:10628); XM_014114900.1, SRSF11, Del, T_9, FMLLVYFV-VIHLCQSHPVSALLSSMIRTQQLWHSI, (SEQIDNO: 10629); XM_014109749.1, ITSN1, Del, T_9, FNLGYLNLF, (SEQIDNO:10630); XM_014106443.1, MYO16, Ins, T_9, FPEAIWISLFIG, (SEQIDNO:10631); XM_005623772.2, SERPINA3, Del, T_9, FPER-SAHWSLFVSTDPFCSAYTTKIRRTSSSGARSPTPIKP, (SEQIDNO:10632); XM_014118021.1, MCHR2, Ins, T_9, FPFAFDFGVLYFNFMLYLGDVSTE, (SEQIDNO:10633); XM_540560.5, ELP4, Del, T_9, FQKNYPQLLI, (SEQIDNO:10634); XM_005639096.2, CCNG2, Ins, T_9, FQLQSGTDTVLSIL, (SEQIDNO:10635); XM_014106522.1, FOXL2, Ins, T_9, FQSPLEKTLQYQQNTTT, (SEQIDNO:10636); XM_003638934.3, ABCC11, Del, T_9, FRCLRHP-STCSRGWRTTAAPLCSPTFSPLFRA, (SEQIDNO: 10637); XM_005623772.2, SERPINA3, Ins, T_9, FRKDRPTGHCSFQQTLSVLHTPQRY-GEHPLLGQGHQPQSSL, (SEQIDNO:10638); XM_536488.5, C6, Del, T_9, FRKKKWNTGVPL-TRCPRNTKVPFCREQRNPYP, (SEQIDNO:10639); XM_005625919.2, APOL6, Del, T_9, FSFTEAHL, (SEQIDNO:10640); XM_014118398.1, KCTD20, Del, T_9, FSGQADSSGFRIQA, (SEQIDNO:10641); XM_014111218.1, ZC3H11A, Del, T_9, FSILHVPKVTAVPSVTVKLH, (SEQIDNO:10642); XM_003435295.1, SLFN5, Ins, T_9, FSKLGCGHW-SIREAGSNL, (SEQIDNO:10643); XM_014106522.1, FOXL2, Del, T_9, FSKSTRKNTTISAKYNNMN, (SEQIDNO:10644); XM_014118812.1, CLOCK, Ins, T_9, FSNHDRWKHNICV, (SEQIDNO:10645); XM_014106443.1, MYO16, Del, T_9, FSRSHLDFS-LYWMKKVR, (SEQIDNO:10646); XM_005635440.2, EXOSC8, Del, T_9, FSSRFACLKGLWNLWSITGDF, (SEQIDNO:10647); XM_005639096.2, CCNG2, Del, T_9, FSTSKWHRHCAFHL, (SEQIDNO:10648); XM_005637816.2, FAM24B, Del, T_9, FTAGIHRTWKT, (SEQIDNO:10649); XM_014106247.1, LOC102155967, Del, T_9, FTGTLITEVSYSAFILATHSGVQHLSSYLDL, (SEQIDNO:10650); XM_014120987.1, LOC100684857, Del, T_9, FWKKTQFLIIYVPHRELST, (SEQIDNO: 10651); XM_542618.5, FBXL3, Del, T-9, FYMKRN-LIHSFGMKYLPPIFTLGDQ, (SEQIDNO:10652); XM_531662.5, TMBIM4, Del, T_9, FYTLSLYGH-LYMKVLP, (SEQIDNO:10653); XM_014115464.1, ZNF396, Ins, T_9, LFFKIYFYRESGVWQGGGQK-EREFQADSPL, (SEQIDNO:10654); XM_005615357.1, PIGN, Del, T_9, LHHLSCFLNLNS, (SEQIDNO:10656); XM_005618779.2, RYR2, Del, T_9, LLLISLTLLWGSKH, (SEQIDNO:10657); XM_005637816.2, FAM24B, Ins, T_9, LLRAFIEHGRLRG, (SEQIDNO:10658); XM_014116728.1, INTS2, Del, T_9, LSHL-SYLRVQSIWRKLQMYFVFYKQSSLPCFL, (SEQIDNO: 10659); XM_014110073.1, GABRR3, Ins, T_9, LSQTLLER, (SEQIDNO:10660); XM_532552.5, UTP11L, Del, T_9, LTPKRKLSSLILPLT, (SEQIDNO:10661); XM_014109749.1, ITSN1, Ins, T_9, SIWVTSTCFSTDM-GAS, (SEQIDNO:10662); XM_540560.5, ELP4, Ins, T_9, SRKIIPNS, (SEQIDNO:10663); XM_014110515.1, ZNF165, Ins, T_9, SSGSSPCTWTRDIQEKGGTFWTST, (SEQIDNO:10664); and XM_849037.4, TSPAN18, Ins, T_9, SVHPHHLLGGALGGHPGLHLQGK-SHSRVLHQGAHQALPGQQ, (SEQIDNO:10665).

EXAMPLES

The following examples are given for the purpose of illustrating various embodiments of the invention and are not meant to limit the present invention in any fashion. The present examples, along with the methods described herein are presently representative of preferred embodiments, are exemplary, and are not intended as limitations on the scope of the invention. Changes therein and other uses which are encompassed within the spirit of the invention as defined by the scope of the claims will occur to those skilled in the art.

Example 1: Screening Human Cancer Patients for Vaccine Candidates

The peptide sequence of the FSP array was from our human or dog FS database. It includes the most of the MS FS antigens (homopolymer size >6 nt, peptide size >9 a.a) and potential FSP caused by mis-splicing of each exon. All FS antigens were segmented into 10 to 15 a.a long peptides. The array was synthesized by Nimblegen with photolithography. There were about 400K peptides of each FSP array, including ~14 K MS FSPs.

Figure 8A:
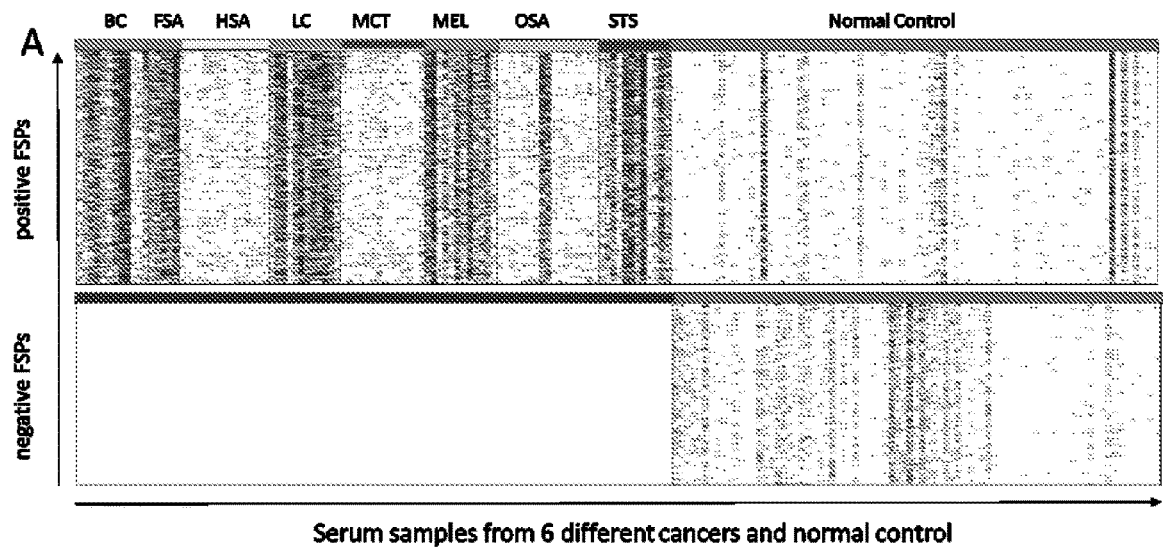
FIG. 8A, FIG. 8B, and FIG. 8C show 400K FSP array screen antibody reactive in cancer patient and examples of using the SPCV system identify FS antigens for personalized cancer vaccine.
Figure 8B:
Figure 8C:
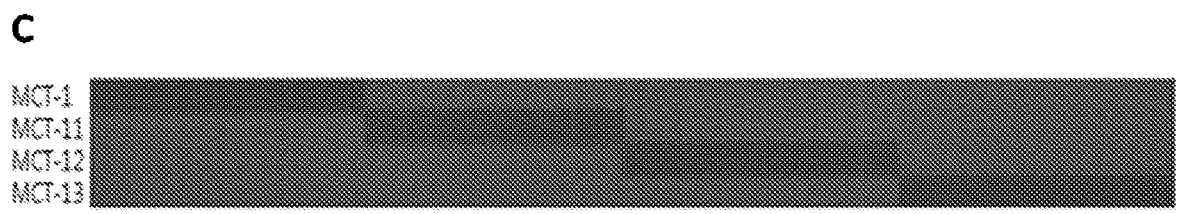

Total 96 cancer serum from 8 different cancers and 81 non-cancer normal controls were analyzed with the 400K array (FIG. 8A and FIG. 8B). Cancer patients had much higher IgG reactive to the FSPs. However, there is still a small portion FSPs don't have IgG positive reactive in cancers (FIG. 8A). It was determined that positive IgG reactive FSPs have better protection (FIG. 9, FIG. 10, FIG. 11). Based on the IgG reactivity to FSPs, 20 best reactive FS antigens can be selected for each cancer patient as personalized cancer vaccine. (FIG. 8B and FIG. 8C).

Example 2: Screening Dog Cancer Patients For Vaccine Candidates

Blood from dogs with various cancers was used to screen vaccine candidate peptides. 830 spotted peptides corresponding to 374 different FS antigens from 209 genes in dogs. Sera from dogs with 8 different cancers, (N=116), including mammary cancer, were compared to sera from dogs without cancer (N=52). Results of the screen are shown in FIG. 9. Red spots indicate the normalized florescent value of the peptide was 5 fold higher than in the corresponding sample. There were a total 487 FS peptides had at least one example of 5 fold higher reactivity. The dogs with cancer also showed higher antibody reactive to the FS peptide. Each type of cancer has its own reactive profile, as well as each individual dogs.

Figure 13A:
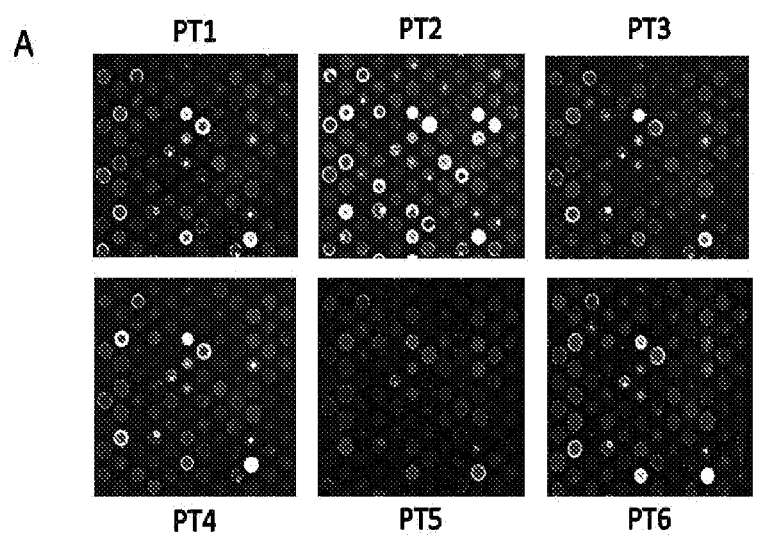
FIG. 13A and FIG. 13B shows data identifying personal reactive FS antigens and detection of the T cell responses to some of these FS antigens in the same dog.
Figure 13B:
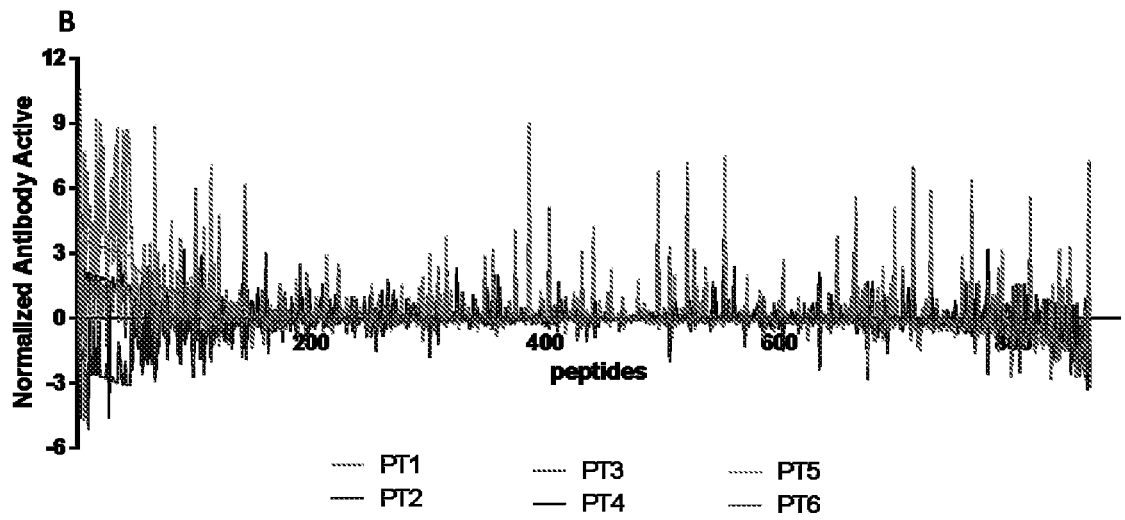

Data from individual dogs is shown in FIG. 13A and FIG. 13B. Screening of 6 dogs with cancer for specific cancer vaccine candidates. In FIG. 13A, a corner of the scanned FS array of each cancer dog analysis is shown. In FIG. 13A, data is shown of normalized antibody active to each peptide of each cancer dog. These data showed that each dog has personal highly reactive FS peptides.

Figure 14:
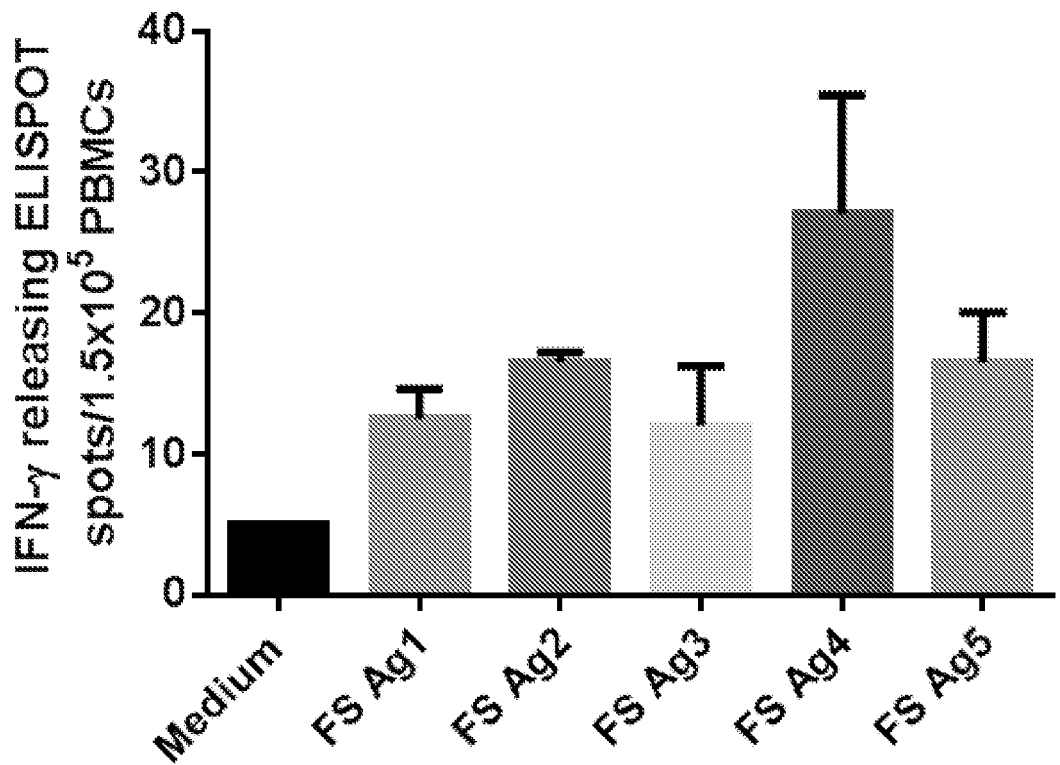
FIG. 14 shows data identifying personal reactive FS antigens and detection of the T cell responses to some of these FS antigens in the sanle dog. For a specific dog screened using the arrays in FIG. 9, 5 FS antigens that were highly antibody reactive were tested in ELI-Spot assays. PBMCs from the dog's blood were purified, stimulated with pooled peptides from each FS antigen candidates and the number of positive cells counted. The number for positive for each FS antigen stimulant is shown. As can be seen all 5 FS antigens showed significant T-cell reactivity compare to the medium control.

T-cell reactivity was determined for candidate vaccine peptides. For a specific dog screened using the arrays in FIG. 13A and FIG. 13B, 5 FS antigens that were highly antibody reactive were tested in ELI-Spot assays. PBMCs from the dogs' blood were purified, stimulated with pooled peptides from each FS antigen candidates and the number of positive cells counted. The number for positive for each FS antigen stimulant is shown. As can be seen all 5 FS antigens showed significant T-cell reactivity compared to the medium control (FIG. 14).

Example 3: Cancer Vaccine for Dogs

Figure 15A:
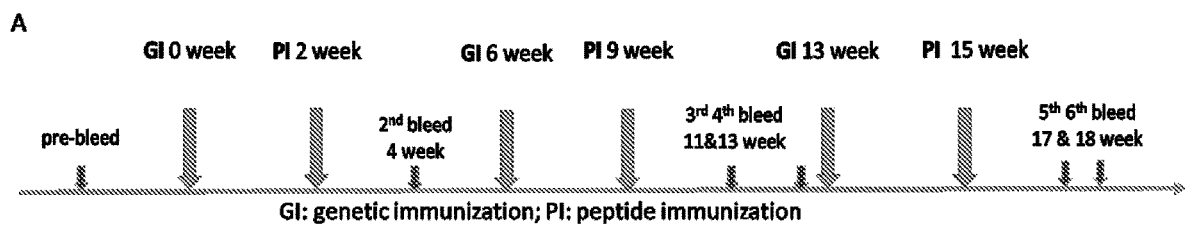
FIG. 15A, FIG. 15B, and FIG. 15C show the result of the dog cancer vaccine safety trial.
Figure 15B:
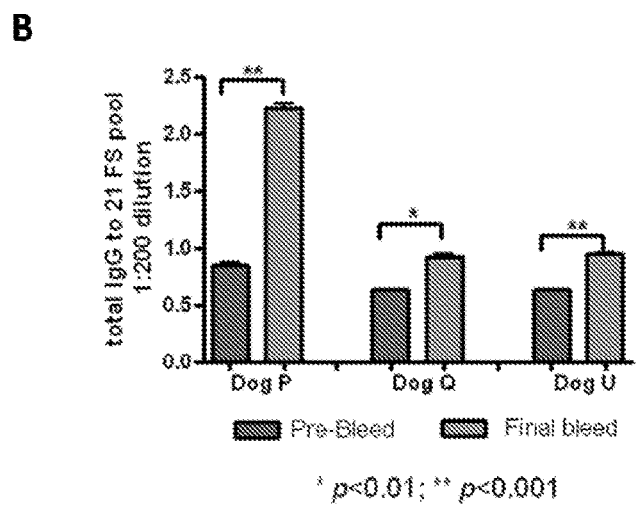
Figure 15C:
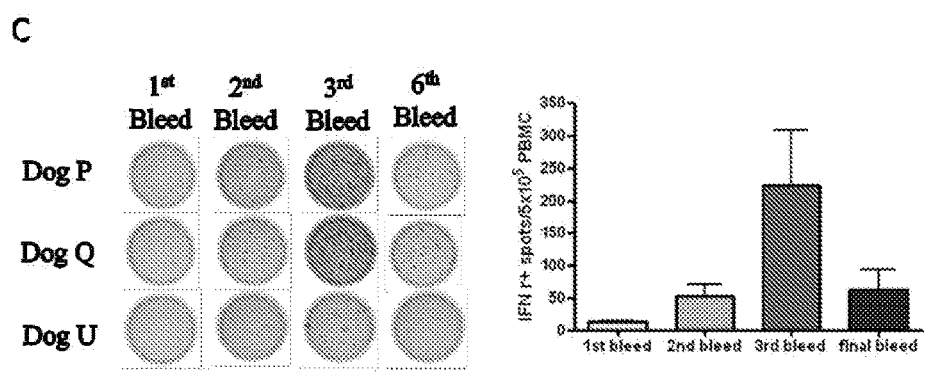

A safety trial of FS peptide based cancer vaccine was conducted in dogs. The cancer vaccine was formulated with 21 FS antigens. Three healthy dogs were immunized with the vaccine according to the timeline shown in FIG. 15A. An ELISA analysis was conducted on the antibody reactivity of the immunization, shown in FIG. 15B. ELISPOT analysis was conducted to measure the specific IFNγ releasing PBMCs to the vaccine antigens after immunization, shown in FIG. 15C. Standard clinicopathologic analysis showed the vaccine is safe for these three dogs.

Example 4: Frameshift Peptide Vaccines Protect Against Cancer

Figure 16A:
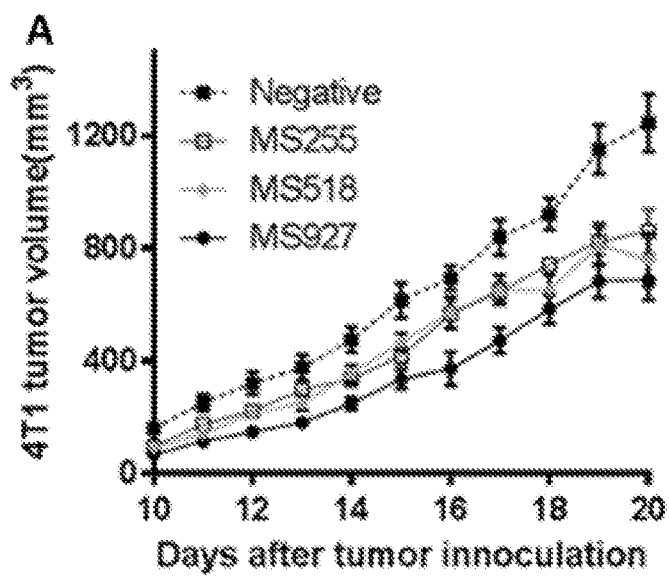
FIG. 16A and FIG. 16B show that FSPs have significant protection as vaccine candidates in different mouse tumor model.
Figure 16B:
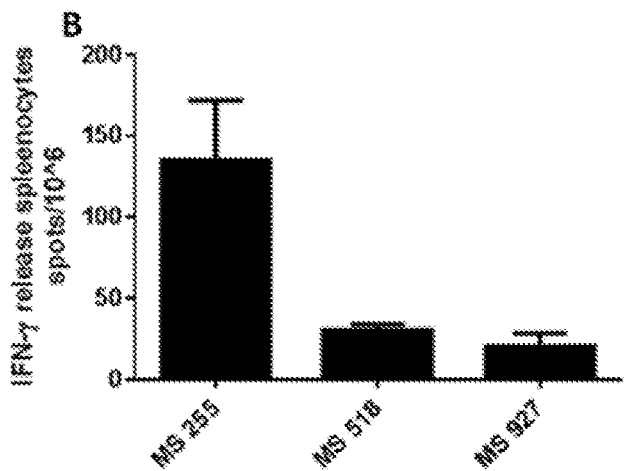

To determine whether any MS Indel event could produce a FS in any constitutive gene and could therefore be a protective antigen against most or all tumor types, three predicted MS FSs in mouse genes were selected using the criteria of FS peptide length and predicted H2-D epitopes (Table 3). Each FS peptide was tested individually in the 4T1-BALB/c mouse breast tumor model with the prophylactic vaccination of gene vaccine/peptide boost. Each FS peptide vaccination significantly slowed the tumor growth compared to the mock immunized mice (FIG. 16A). Each FS antigen can elicit specific IFNγ releasing splenocytes (FIG. 16B). These results indicate that any FSs produced by MS can confer protection. Peptides tested are listed in Table 1.

TABLE 3

The three MS FSPs (SEQ ID NOS 10666-10668, respectively, in order of appearance) with predicted H2-D epitopes for the vaccine test.

| Gene ID | MS type | FS type | FS size | FS peptide (Kd/Ld > 20) |
|---|---|---|---|---|
| MS0518 | 10A | Del | 59 aa | TLCMEVMLRWNTRELGY-LYLQLCFLNTHFLHTSQEEKLLTL-GRFLTWTSRCGSFVIRPL (SEQ ID NO: 10666) |
| MS7927 | 9A | Del | 33 aa | ICMSPPLLWATLQAPETTSAACKASYRPEG-LYL (SEQ ID NO: 10667) |
| MS2255 | 9A | Ins | 25 aa | YFSCDKRCIKHYAGNKSLLTFSGY (SEQ ID NO: 10668) |

In another demonstration, two different pools of mouse FS antigen of the different MS length were selected (Table 4) and tested in the same mouse tumor model. Both FS pooled vaccine significantly retarded tumor growth comparing to the control group (FIG. 17A and FIG. 171B).

TABLE 4

Two pools of the FS antigens from the different MS length.

| Ag ID | Ref Gene | MS type | INDEL | peptide size (aa) |
|---|---|---|---|---|
| Short MS pool | | | | |
| Mus385 | NM_146792.2 | 8T | Deletion | 32 |
| Mus392 | NM_029998.3 | 8T | Deletion | 51 |
| Mus023 | NM_147003.1 | 8T | Insertion | 19 |
| Mus263 | NM_001114663.1 | 8A | Insertion | 20 |
| Mus942 | NM_001081355.3 | 8A | Insertion | 37 |
| Mus671 | NM_001163189.1 | 8A | Insertion | 49 |
| Mus334 | NM_130448.3 | 8A | Deletion | 29 |
| Mus051 | NM_033618.3 | 8A | Insertion | 26 |
| Mus587 | NM_001081302.1 | 8A | Insertion | 32 |
| MS255 | NM_010086.4 | 9A | Insertion | 24 |
| MS927 | NM_053009.3 | 9A | Deletion | 33 |
| MS518 | NM_153511.3 | 10A | Deletion | 59 |
| Long MS pool | | | | |
| Mus487 | NM_001109759.1 | 10A | Deletion | 44 |
| Mus413 | NM_027009.2 | 10A | Deletion | 27 |
| Mus274 | NM_001081345.2 | 10A | Insertion | 14 |
| Mus694 | NM_028787.4 | 10T | Insertion | 45 |
| Mus281 | NM_001160399.1 | 11A | Deletion | 39 |
| Mus951 | NM_025441.3 | 11A | Deletion | 36 |
| Mus461 | NM_001033226.4 | 13T | Deletion | 22 |
| Mus528 | NM_001034881.3 | 14T | Deletion | 54 |
| Mus414 | NM_028664.1 | 18T | Deletion | 28 |

The FS vaccine was also tested in a mouse ovarian cancer model (ID8-C57BL6). A pool of FSP from 10 MS FS and 3 mis-splicing FS was immunized, as well as a pool of peptides from the point DNA mutation if the 1D8 cells were immunized the mice after the tumor cell injection. Both vaccines showed the significant protection comparing to the control mice which were immunized with PBS (FIG. 18). The same sets of the vaccines combined with immune checkpoint treatment also showed the significant protection. This experiment shows our FS variants have the same protection as the neo-antigens from the DNA mutations.

Example 5: Personalized Vaccine Test in Mouse Tumor Models

Protection by personalized pool FS neoantigens was tested in the 4T1 BALB/c tumor model (FIG. 19). Serum from BALB/c mice (n=10/group) were collected two days previous and 7-days post subcutaneous injection of 4T1 tumor cells (500 cells/mouse). Both sera were run on microarray slides containing peptides for human FS neoantigens and the 10 mouse homologs neoantigens with higher median normalized signal on the array were selected as targets for the vaccines formulations for each mice. Mice were vaccinated subcutaneously on days 12 and 19. For the immunization group with the combined immunotherapy, the antibody treatment, anti-PD-L1 and CTLA-4, were administrated intraperitoneally on days 12, 15, 19, 22. Control group (non-treated) was immunized with PBS at the same schedule as the vaccine groups. Non-reactive groups were immunized with FS antigens without signal in the microarray before and after tumor challenge, and followed the same vaccine regimen as the other groups. The test shows that the personalized positive FSPs selected from the FSP array have significant protection as a vaccine. It also shows again that the negative IgG reactive FSPs don't have the protection.

The personalized cancer vaccine was also tested in a spontaneous mouse breast tumor model (FIG. 20). Female FVB/N mice (n=22) were evaluated weekly for the presence of palpable tumor, when tumor was detected sample blood was collected and run on microarray slides containing peptides for human FS neoantigens. The 10 mouse homologs neoantigens with higher median normalized signal compared to age matched FVB/NJ samples on the array were selected as targets for the vaccines formulations for each mice. Mice were vaccinated subcutaneously with pool of FS peptide with minimum two doses and maximum seven doses, as needed to maintain tumor control, with intervals 1-2 weeks between doses. Each vaccine dose was followed by checkpoint inhibitor treatment (antibody anti-PD-L1 and anti-CTLA-4) (CPI), two doses, three days a part. As control groups, animals were immunized with PBS (non-treated) at the same schedule as the vaccine groups or only with CPI treatment (CPI only), twice per animal. Personalized FS vaccine conferred 68.2% of protection. Both personalized cancer vaccine tests with our SPCV system showed significant protection in two different mouse tumor models. It suggests the SPCV system may also work with human cancer treatment.

Example 5: Personalized Cancer Vaccine

An individual presenting with histologically confirmed stage 1 mammary cancer is in need of treatment. A blood sample is obtained from the individual and serum from the blood sample is applied to a peptide array having approximately 20,000 spotted FS peptides. After incubation, the array is washed and the patient's bound antibodies are detected using a fluorescently labeled secondary antibody. FS peptides are found to bind specifically to the patient's sera and not to sera from healthy individuals.

These reactive FS peptides are prepared in a vaccine preparation including a poly I:C adjuvant and administered to the individual with a checkpoint inhibitor or combination of checkpoint inhibitors after receiving a lumpectomy surgery. The individual is monitored for mammary cancer recurrence and is cancer-free for five years.

Example 6: Clinical Trial for a Personalized Cancer Vaccine

Ten individuals presenting with histologically confirmed stage 1 mammary cancer are in need of treatment. Blood samples are obtained from each individual and serum from the blood samples were applied to peptide arrays having approximately 20,000 spotted FS peptides. After incubation, the arrays are washed and the patients' bound antibodies are detected using a fluorescently labeled secondary antibody. FS peptides are found to specifically bind to the patients' sera but not to sera from healthy individuals. Reactive FS peptides are prepared in a vaccine preparation for each patient including a poly I:C adjuvant. The FS vaccine components are chosen from pre-synthesized reagents. Each individual is given their vaccine after receiving lumpectomy surgery. Vaccinated individuals are monitored for manlmary cancer recurrence and nine of the ten individuals remain cancer free for five years. Ten individuals receive a lumpectomy surgery only and six of the ten individuals remain cancer free for five years. This Example demonstrates that a personalized cancer vaccine provides increased efficacy in mammary cancer treatment compared to lumpectomy surgery only.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (10674 sequences)

SEQ ID NO: 1 - protein, 12 aa, Canis lupus familiaris
ICLLFASERVGI

SEQ ID NO: 2 - protein, 20 aa, Canis lupus familiaris
IGAFPGYCSKGAQKSKDMDA

SEQ ID NO: 3 - protein, 8 aa, Canis lupus familiaris
KCFKRASA

SEQ ID NO: 4 - protein, 31 aa, Canis lupus familiaris
KDKSKEGMILSQRNLFCLQNLLNPYSVAAWP

SEQ ID NO: 5 - protein, 10 aa, Canis lupus familiaris
KEKVLFIQFH

SEQ ID NO: 6 - protein, 12 aa, Canis lupus familiaris
KERISSIFFLPL

SEQ ID NO: 7-8 - skipped (2 entries)

SEQ ID NO: 9 - protein, 10 aa, Canis lupus familiaris
KFWQERKQRN

SEQ ID NO: 10 - protein, 66 aa, Canis lupus familiaris
KGKGLIHPVPLKRTLPSKRNKNTRRKKRRKKKRISQKEGNIIKRKKRREKRRSIHPLLILLRSPKS

SEQ ID NO: 11 - protein, 19 aa, Canis lupus familiaris
KGREKERKGARKACETSYN

SEQ ID NO: 12 - protein, 11 aa, Canis lupus familiaris
KGTKFALSTAQ

SEQ ID NO: 13 - protein, 15 aa, Canis lupus familiaris
KHVLCHLITQMTKKN

SEQ ID NO: 14 - protein, 22 aa, Canis lupus familiaris
KIRHTDTQRDLQVFQLREYLLQ

SEQ ID NO: 15 - protein, 20 aa, Canis lupus familiaris
KIRHTDTQRDLQVSCGFLQS

SEQ ID NO: 16 - protein, 62 aa, Canis lupus familiaris
KKERKPACSQTVSSPETTTMRTASASLTGGSRVHASLGTGPSMWTPSRCRGRLKTESQRPSP

SEQ ID NO: 17 - protein, 18 aa, Canis lupus familiaris
KKGFPASSFFPFEKIRNM

SEQ ID NO: 18 - protein, 10 aa, Canis lupus familiaris
KKRIWSHQQE

SEQ ID NO: 19 - protein, 41 aa, Canis lupus familiaris
KLSRQGTSWKLRTRECSQNNKQGSSIVAKRRSLTFKILSFL

SEQ ID NO: 20 - protein, 11 aa, Canis lupus familiaris
KPGTSLQCYLN

SEQ ID NO: 21 - protein, 36 aa, Canis lupus familiaris
KPPITLGILTLIQGHHPIPGFSLLLEPPSTAFLVFP

SEQ ID NO: 22 - protein, 13 aa, Canis lupus familiaris
KQSKARDKAGGMY

SEQ ID NO: 23 - protein, 57 aa, Canis lupus familiaris
KQWSSVTSLEWTAQERGCSSWLMKRTWMKSWSLRDPSCRSTQEYISTQALWTPISTA

SEQ ID NO: 24 - protein, 14 aa, Canis lupus familiaris
KRKRKRKKRSQKSL

SEQ ID NO: 25 - protein, 16 aa, Canis lupus familiaris
KRNKVCLIHCTIAHRL

SEQ ID NO: 26 - protein, 60 aa, Canis lupus familiaris
KRNWPRKQGKRLLTIWLLGKMNELGSEWSTLSEKITLWRPWRSWSYIVICCWLGLASSSL

SEQ ID NO: 27 - protein, 56 aa, Canis lupus familiaris
KRSNKMILMNTMMTLQLQLHFSHSLFSLNKVISPRWCNQDCHQFQEHQECLQAYLH

SEQ ID NO: 28 - protein, 17 aa, Canis lupus familiaris
KRTLENAGLFPWLRTQC

SEQ ID NO: 29 - protein, 12 aa, Canis lupus familiaris
KSGTQTLSGIFK

SEQ ID NO: 30 - protein, 15 aa, Canis lupus familiaris
KSGTQTLSGIFKFFN

SEQ ID NO: 31 - protein, 21 aa, Canis lupus familiaris
KSRTRNYQWDSHFLSLVGSPR

SEQ ID NO: 32 - protein, 24 aa, Canis lupus familiaris
KTKQQTVVTTLSQKKVKIKKRTGK

SEQ ID NO: 33 - protein, 12 aa, Canis lupus familiaris
KVVINSKRPQKF

SEQ ID NO: 34 - protein, 9 aa, Canis lupus familiaris
KWRSLQCQP

SEQ ID NO: 35 - protein, 8 aa, Canis lupus familiaris
NERVFPCR

SEQ ID NO: 36 - protein, 23 aa, Canis lupus familiaris
NFNSFLVDPLTFRRKTVALVFLP

SEQ ID NO: 37 - protein, 37 aa, Canis lupus familiaris
NGGASNVNHSCQMVEKIHATHRRPSVSNPEAVRVWAN

SEQ ID NO: 38 - protein, 12 aa, Canis lupus familiaris
NGTGPESKERDC

SEQ ID NO: 39 - protein, 11 aa, Canis lupus familiaris
NKTQKDKSEFK

SEQ ID NO: 40 - protein, 27 aa, Canis lupus familiaris
NLHLCPYHSQSNRNKSRQMELLGVKLR

SEQ ID NO: 41 - protein, 12 aa, Canis lupus familiaris
NMPAVCIRTCWY

SEQ ID NO: 42 - skipped

SEQ ID NO: 43 - protein, 33 aa, Canis lupus familiaris
NQGQEITSGIHIFFPLSAVQDRRGHPDHLDKEI

SEQ ID NO: 44 - protein, 21 aa, Canis lupus familiaris
NSGKRGNREIKFKVHTPGVTR

SEQ ID NO: 45 - protein, 25 aa, Canis lupus familiaris
NSPNGSRKRKKSCNFRINHGGLEPN

SEQ ID NO: 46 - protein, 12 aa, Canis lupus familiaris
NVKGWSRPLKFC

SEQ ID NO: 47 - protein, 29 aa, Canis lupus familiaris
NWSLPRVLLQRCPKKQRHGCLKCMTIRQM

SEQ ID NO: 48 - protein, 10 aa, Canis lupus familiaris
NYRGRVRLGN

SEQ ID NO: 49 - protein, 19 aa, Canis lupus familiaris
RKKENQHAHRPYLPQRRLP

SEQ ID NO: 50 - protein, 9 aa, Canis lupus familiaris
SLVPHCNVT

SEQ ID NO: 51 - protein, 21 aa, Canis lupus familiaris
SNKRRRWIYRKAVTCICGTGR

SEQ ID NO: 52 - protein, 8 aa, Canis lupus familiaris
SPQLPWES

SEQ ID NO: 53 - protein, 24 aa, Canis lupus familiaris
TGDIKSNSTAQPTLQISFRPKEGA

SEQ ID NO: 54 - protein, 8 aa, Canis lupus familiaris
TMPTAQRP

SEQ ID NO: 55 - protein, 37 aa, Canis lupus familiaris
TSDFPMCWLRQSNSRSVYSEGFSGFGMACGMFEMCGV

SEQ ID NO: 56 - protein, 9 aa, Canis lupus familiaris
TSTVSWWIR

SEQ ID NO: 57 - protein, 23 aa, Canis lupus familiaris
TYTCALTTVKATETKAGKWNCWE

SEQ ID NO: 58 - protein, 12 aa, Canis lupus familiaris
ILLNLSSESCTF

SEQ ID NO: 59 - protein, 39 aa, Canis lupus familiaris
KARGGNVPAERKGRGREPRTERARQRAELRAPPPPPRRA

SEQ ID NO: 60 - protein, 8 aa, Canis lupus familiaris
KDSASTLS

SEQ ID NO: 61 - protein, 88 aa, Canis lupus familiaris
KEALLLQEVLQAERLLLQEEQEGGGRGGGRGGGGRARRRPQGRGRRAGRAGAGAAAGAGAGAGAGAGAGGRGRGGRGGGRGGRRAPGG

SEQ ID NO: 62 - protein, 23 aa, Canis lupus familiaris
KEERTLYSMHLFQVPGNILMGTT

SEQ ID NO: 63 - protein, 23 aa, Canis lupus familiaris
KEKYRSRFYSKCLISIRSWIKTT

SEQ ID NO: 64 - skipped

SEQ ID NO: 65 - protein, 18 aa, Canis lupus familiaris
KHGMTHHLVCSPRSSFSC

SEQ ID NO: 66 - protein, 16 aa, Canis lupus familiaris
KLKDYGLIKPISGIVP

SEQ ID NO: 67 - protein, 58 aa, Canis lupus familiaris
KMGKRKSLKRRKLQELPKRRKLRKNSNLSHMMIKFFWMEMRYLCGSMTQFTLKHLSWD

SEQ ID NO: 68 - protein, 35 aa, Canis lupus familiaris
KRREPSTQCTYFKSQGTSSWVQPDSHNQPTANCCG

SEQ ID NO: 69 - protein, 12 aa, Canis lupus familiaris
KRSASPSRSPSS

SEQ ID NO: 70 - protein, 18 aa, Canis lupus familiaris
KSDEESEDCFGKDAVLQM

SEQ ID NO: 71 - protein, 22 aa, Canis lupus familiaris
KSFESREPIRFIFTRLKRSGFF

SEQ ID NO: 72 - protein, 16 aa, Canis lupus familiaris
KTLPQPSAEQLCRSSL

SEQ ID NO: 73 - protein, 13 aa, Canis lupus familiaris
KVNSEEIVRNLSE

SEQ ID NO: 74 - protein, 37 aa, Canis lupus familiaris
KYYPAKTSEGCASPSGYLCLMIFWDPYCPGLKTAKNK

SEQ ID NO: 75 - protein, 11 aa, Canis lupus familiaris
NKCQIIRERSM

SEQ ID NO: 76 - protein, 24 aa, Canis lupus familiaris
NNTRELWEYPQKRTICCFQQSLCV

SEQ ID NO: 77 - protein, 15 aa, Canis lupus familiaris
SHSSPANQFDLFLHV

SEQ ID NO: 78 - protein, 19 aa, Canis lupus familiaris
SITQQRHQKAVQVLQVTFV

SEQ ID NO: 79 - protein, 19 aa, Canis lupus familiaris
KEVWESHHPQSLIHLLWAK

SEQ ID NO: 80 - protein, 8 aa, Canis lupus familiaris
KGKWITYF

SEQ ID NO: 81 - protein, 17 aa, Canis lupus familiaris
KGNGSLTFENPYIATFQ

SEQ ID NO: 82 - protein, 19 aa, Canis lupus familiaris
KGNGSLTFENPYIATFQWL

SEQ ID NO: 83 - protein, 24 aa, Canis lupus familiaris
KKSGNHTILKASSTCCGQSDSSQH

SEQ ID NO: 84 - protein, 8 aa, Canis lupus familiaris
KPKALKLN

SEQ ID NO: 85 - protein, 11 aa, Canis lupus familiaris
RIHRCTEISNN

SEQ ID NO: 86 - protein, 8 aa, Canis lupus familiaris
KEEGTISP

SEQ ID NO: 87 - protein, 10 aa, Canis lupus familiaris
KEHSGGGISK

SEQ ID NO: 88 - protein, 63 aa, Canis lupus familiaris
KEMHLKEGISELCPLLLLQMQLSANQAPTHQMGLKRVNRVLWAVISQHLVPRAASCVQKTLHL

SEQ ID NO: 89 - protein, 9 aa, Canis lupus familiaris
KGTLCAVWG

SEQ ID NO: 90 - protein, 9 aa, Canis lupus familiaris
KKKEPSAHN

SEQ ID NO: 91 - skipped

SEQ ID NO: 92 - protein, 10 aa, Canis lupus familiaris
KPVPEGRAGV

SEQ ID NO: 93 - protein, 8 aa, Canis lupus familiaris
KTLKVQKD

SEQ ID NO: 94 - protein, 25 aa, Canis lupus familiaris
NLCYLVFCTISVEIKCPPNGHAGHL

SEQ ID NO: 95 - protein, 8 aa, Canis lupus familiaris
NVRVPTWT

SEQ ID NO: 96 - protein, 13 aa, Canis lupus familiaris
TCVTWCFVQYLWK

SEQ ID NO: 97 - protein, 26 aa, Canis lupus familiaris
KKKKAKSTPPVRGTPTSCSRGEAPQH

SEQ ID NO: 98-99 - skipped (2 entries)

SEQ ID NO: 100 - protein, 22 aa, Canis lupus familiaris
KSFESREPIRFIFTRLKRSGYF

SEQ ID NO: 101 - protein, 13 aa, Canis lupus familiaris
KSTLGSWRIPTTL

SEQ ID NO: 102 - protein, 39 aa, Canis lupus familiaris
KTNTTGFRLLLFSPCPSVSLLGKQVLRQARPPRPGATSL

SEQ ID NO: 103 - protein, 13 aa, Canis lupus familiaris
KTRRVSTSTSPGF

SEQ ID NO: 104 - protein, 16 aa, Canis lupus familiaris
KVLLGPGESQLHFDRV

SEQ ID NO: 105 - skipped

SEQ ID NO: 106 - protein, 29 aa, Canis lupus familiaris
RRKKQRAPHLSEAHPPPAAEEKPRSTDQR

SEQ ID NO: 107 - protein, 14 aa, Canis lupus familiaris
TLICFLYISDPVRV

SEQ ID NO: 108 - protein, 64 aa, Canis lupus familiaris
KELQIRGGSAAAAAAAAATCRLRAVPGGEAETRGIPGCGCGCGCDSGSGSGHRRLPPSPAPQRT

SEQ ID NO: 109 - protein, 23 aa, Canis lupus familiaris
KERKEKKKKEKKKKSWLLARLAL

SEQ ID NO: 110 - protein, 27 aa, Canis lupus familiaris
KRKKRKEKERKEKKIVAAGQTRPVSRS

SEQ ID NO: 111 - protein, 67 aa, Canis lupus familiaris
KRVANTRWVRCGCGCGRRYMSPPRSSRRRSGDPRDSGLRLRLRLRLRLRLRPPPAPAQPCPAAHLGL

SEQ ID NO: 112 - skipped

SEQ ID NO: 113 - protein, 12 aa, Canis lupus familiaris
KEFHKYSSKKGI

SEQ ID NO: 114 - protein, 17 aa, Canis lupus familiaris
KEKEKGGGSFKHQKAAH

SEQ ID NO: 115 - skipped

SEQ ID NO: 116 - protein, 21 aa, Canis lupus familiaris
KKKKKVVVLSSTRKQLIRLSP

SEQ ID NO: 117 - protein, 11 aa, Canis lupus familiaris
KLTNIRKRQVS

SEQ ID NO: 118 - protein, 15 aa, Canis lupus familiaris
KNSTSTPPRRVYKGG

SEQ ID NO: 119 - protein, 65 aa, Canis lupus familiaris
KRKARRGAGRQSGSSPWMSIWKEELLFSIPSARGFARRWTPRTRTPVAGASPDYLHTPDLSAFWT

SEQ ID NO: 120 - protein, 8 aa, Canis lupus familiaris
SDGKPRFL

SEQ ID NO: 121 - protein, 21 aa, Canis lupus familiaris
KHCRELTLGIMAPVGRWQHCS

SEQ ID NO: 122 - protein, 71 aa, Canis lupus familiaris
KRLKRIPTKPERRLSPSALGKVELEGSGLRLAKRILLLQSCQNCVHSSALRMEASPAALSVLVVGATSRVR

SEQ ID NO: 123 - protein, 65 aa, Canis lupus familiaris
KTLQGTHPWDYGSSGSVAALLMMKRTPKGVRLMWGAWQRWHRKQMTLPGGSQQTLHRGGAEILGL

SEQ ID NO: 124 - skipped

SEQ ID NO: 125 - protein, 41 aa, Canis lupus familiaris
KEKEAHFPAVHLALLFLRSPFPGKTPVSHLSCSPPCFSSPL

SEQ ID NO: 126 - skipped

SEQ ID NO: 127 - protein, 14 aa, Canis lupus familiaris
KRSPTPASSPPTRW

SEQ ID NO: 128 - protein, 17 aa, Canis lupus familiaris
KRPTHYLVSPKTLLWKA

SEQ ID NO: 129 - protein, 26 aa, Canis lupus familiaris
IAGNGFFHPSFDGQAFAGSKYRAVTI

SEQ ID NO: 130 - protein, 19 aa, Canis lupus familiaris
IATANYPRTPANPKTAYEI

SEQ ID NO: 131 - protein, 30 aa, Canis lupus familiaris
IAYNYSTTCYHHVPCNYRFKTHRFPVSTKV

SEQ ID NO: 132 - protein, 11 aa, Canis lupus familiaris
ICESYITLYVY

SEQ ID NO: 133 - protein, 16 aa, Canis lupus familiaris
ICSSSKLSAAASVHMV

SEQ ID NO: 134 - protein, 11 aa, Canis lupus familiaris
IDKTGSSCFCL

SEQ ID NO: 135 - protein, 9 aa, Canis lupus familiaris
IEELKDTGF

SEQ ID NO: 136 - protein, 18 aa, Canis lupus familiaris
IEFGGQSSQQFARWNRSL

SEQ ID NO: 137 - protein, 9 aa, Canis lupus familiaris
IEKLLRITS

SEQ ID NO: 138 - protein, 10 aa, Canis lupus familiaris
IEVILPRKVI

SEQ ID NO: 139 - protein, 18 aa, Canis lupus familiaris
IFAAQKVGHIFLSSKWGL

SEQ ID NO: 140 - protein, 54 aa, Canis lupus familiaris
IFCHKLLSVSRAQHESYCSWEPLACLCRKQVDSMPSVPWWSLWRQHSVLHCHGH

SEQ ID NO: 141 - protein, 15 aa, Canis lupus familiaris
IFIGGKVVPSRNPFP

SEQ ID NO: 142 - protein, 17 aa, Canis lupus familiaris
IFKSENTFRTDISTSQV

SEQ ID NO: 143 - protein, 8 aa, Canis lupus familiaris
IFQKENSS

SEQ ID NO: 144 - protein, 11 aa, Canis lupus familiaris
IFSDGARREHR

SEQ ID NO: 145 - protein, 20 aa, Canis lupus familiaris
IFWLFIYRSHDSQPEQNIDR

SEQ ID NO: 146 - protein, 23 aa, Canis lupus familiaris
IGQMVSSEASCKRIAWYIDTPFK

SEQ ID NO: 147 - protein, 13 aa, Canis lupus familiaris
IGSSQRSESYCKM

SEQ ID NO: 148 - protein, 19 aa, Canis lupus familiaris
IGTCHQSSTCLSPSAGITS

SEQ ID NO: 149 - protein, 9 aa, Canis lupus familiaris
IGVNSGQRN

SEQ ID NO: 150 - protein, 9 aa, Canis lupus familiaris
IHEIQIRTG

SEQ ID NO: 151 - protein, 16 aa, Canis lupus familiaris
IHFCLSPFFYYKPHRT

SEQ ID NO: 152 - protein, 50 aa, Canis lupus familiaris
IHPKSLEPEGGFLSPAGRRALHGSLSAVSPSPRPLPCSHPLLPAPGARSL

SEQ ID NO: 153 - skipped

SEQ ID NO: 154 - protein, 15 aa, Canis lupus familiaris
IHYLFNSWCWKRQWK

SEQ ID NO: 155 - skipped

SEQ ID NO: 156 - protein, 18 aa, Canis lupus familiaris
IIQTQRNRNWNLNRYSYS

SEQ ID NO: 157 - protein, 14 aa, Canis lupus familiaris
IIRSQKATQPQVCN

SEQ ID NO: 158 - protein, 14 aa, Canis lupus familiaris
IKSVTLCPHRVLRI

SEQ ID NO: 159 - protein, 27 aa, Canis lupus familiaris
ILYLCTGASLELFFLFIGKHPNYHAGF

SEQ ID NO: 160 - protein, 8 aa, Canis lupus familiaris
IMSDDPNL

SEQ ID NO: 161 - protein, 17 aa, Canis lupus familiaris
IMSTSRRTQQWPGSPRR

SEQ ID NO: 162 - protein, 27 aa, Canis lupus familiaris
INEYLWISSHCCVHLLWNYNLHVPTTR

SEQ ID NO: 163 - protein, 8 aa, Canis lupus familiaris
INFSKEEW

SEQ ID NO: 164 - protein, 8 aa, Canis lupus familiaris
IPGWCPRL

SEQ ID NO: 165 - protein, 16 aa, Canis lupus familiaris
IPKSSYRLVGPATKEI

SEQ ID NO: 166 - protein, 12 aa, Canis lupus familiaris
IPKTKWIVGRYS

SEQ ID NO: 167 - protein, 25 aa, Canis lupus familiaris
IPPCTNRCACASQGTFAGCLFFREP

SEQ ID NO: 168 - protein, 31 aa, Canis lupus familiaris
IQAHQEPGGTGHSGREIHHHKVEGYPRTLVP

SEQ ID NO: 169 - protein, 26 aa, Canis lupus familiaris
IQDQTSSGIIFPFILSSQCNCSLSSL

SEQ ID NO: 170 - protein, 23 aa, Canis lupus familiaris
IQEQADNSKNLGGPSECSSDESN

SEQ ID NO: 171 - protein, 19 aa, Canis lupus familiaris
IQHGHNSGPSYSQCLPCLV

SEQ ID NO: 172 - protein, 18 aa, Canis lupus familiaris
IQKRQKGEKEKKERQREH

SEQ ID NO: 173 - protein, 40 aa, Canis lupus familiaris
IQLGKYNQPFTSFFTHFLTDRISNRKDSTPGTKEVYFSFS

SEQ ID NO: 174 - protein, 15 aa, Canis lupus familiaris
IQSEHELDSFKEIKQ

SEQ ID NO: 175 - protein, 8 aa, Canis lupus familiaris
IQSELPPY

SEQ ID NO: 176 - protein, 15 aa, Canis lupus familiaris
IQSRISCWWLYPEFN

SEQ ID NO: 177 - protein, 24 aa, Canis lupus familiaris
IRFRELQRLGCQRTVSAGRESCFG

SEQ ID NO: 178 - protein, 10 aa, Canis lupus familiaris
IRRRCRRETI

SEQ ID NO: 179 - protein, 11 aa, Canis lupus familiaris
IRSKGNCKITG

SEQ ID NO: 180 - protein, 9 aa, Canis lupus familiaris
IRTKNGFIS

SEQ ID NO: 181 - protein, 9 aa, Canis lupus familiaris
IRVCFLGAL

SEQ ID NO: 182 - protein, 13 aa, Canis lupus familiaris
ISEERIDWPSIYF

SEQ ID NO: 183 - protein, 33 aa, Canis lupus familiaris
ISGRSRKERKAAGGLQRGDFQDAGLEHDQSCTS

SEQ ID NO: 184 - protein, 32 aa, Canis lupus familiaris
ISLHAERAYQQVQVCRVWPRLQHVPSVLCLCS

SEQ ID NO: 185 - protein, 18 aa, Canis lupus familiaris
ISRTQTSSFTTRLLVRNY

SEQ ID NO: 186 - protein, 38 aa, Canis lupus familiaris
ISSLTFYTYYKSTYKCCQCGFFSRFNPNLRWRRRITWW

SEQ ID NO: 187 - protein, 20 aa, Canis lupus familiaris
ISSSINDQPPCTKFIWNSKG

SEQ ID NO: 188 - protein, 13 aa, Canis lupus familiaris
ISTRKNGRGPKGK

SEQ ID NO: 189 - protein, 8 aa, Canis lupus familiaris
ISVCLYRA

SEQ ID NO: 190 - protein, 12 aa, Canis lupus familiaris
ITGEEGLYSKNY

SEQ ID NO: 191 - protein, 24 aa, Canis lupus familiaris
ITVLFTMQSGCELPVTARGTQHRI

SEQ ID NO: 192 - protein, 8 aa, Canis lupus familiaris
IVGCYNRA

SEQ ID NO: 193 - protein, 32 aa, Canis lupus familiaris
IWHGEECSDVPGFSGGISWDSAGGEAESVFGM

SEQ ID NO: 194 - protein, 8 aa, Canis lupus familiaris
IWSIVGQL

SEQ ID NO: 195 - protein, 15 aa, Canis lupus familiaris
IWYLSKRHFSSNCLH

SEQ ID NO: 196 - protein, 10 aa, Canis lupus familiaris
IYGRAENGLR

SEQ ID NO: 197 - protein, 36 aa, Canis lupus familiaris
IYLQRKKAVLCWKRQKTKSFGNCFRRRKKESPKRVP

SEQ ID NO: 198 - protein, 11 aa, Canis lupus familiaris
IYPSCYFNPSC

SEQ ID NO: 199 - protein, 11 aa, Canis lupus familiaris
IYRGSGYKDHR

SEQ ID NO: 200 - protein, 41 aa, Canis lupus familiaris
IYSCSTSTSAWLVSKKKNFRTKNQNQTSSLHSSCILSPVCS

SEQ ID NO: 201 - protein, 19 aa, Canis lupus familiaris
KAAHQRFLFWLLQGNWQTK

SEQ ID NO: 202 - skipped

SEQ ID NO: 203 - protein, 21 aa, Canis lupus familiaris
KAASLLRKRLLRRSLLRRGLL

SEQ ID NO: 204 - protein, 20 aa, Canis lupus familiaris
KAATKWRKMNSSVTSRRVKI

SEQ ID NO: 205 - protein, 16 aa, Canis lupus familiaris
KAAVCYQLFSNVPSSG

SEQ ID NO: 206 - protein, 22 aa, Canis lupus familiaris
KAAWSPRHENFGSRRYGLLWNL

SEQ ID NO: 207 - protein, 21 aa, Canis lupus familiaris
KACCPVPCHREQRQPVLPRLL

SEQ ID NO: 208 - protein, 18 aa, Canis lupus familiaris
KACEPKQTGITFTKTSWK

SEQ ID NO: 209 - protein, 11 aa, Canis lupus familiaris
KACHAFYLVLS

SEQ ID NO: 210 - protein, 10 aa, Canis lupus familiaris
KACTWFLRYF

SEQ ID NO: 211 - protein, 64 aa, Canis lupus familiaris
KADKAKPGSGTTSRFLKQGAVWICGNGGPVTWPSLLKWMCRNTPEGRGRPDATSPLQGSGQPPR

SEQ ID NO: 212 - protein, 21 aa, Canis lupus familiaris
KADLHLSSPPLMMNKSLSSQE

SEQ ID NO: 213 - protein, 12 aa, Canis lupus familiaris
KAEGRERSSREG

SEQ ID NO: 214 - protein, 11 aa, Canis lupus familiaris
KAEKATAGSCV

SEQ ID NO: 215 - protein, 12 aa, Canis lupus familiaris
KAEKNSLHRYIW

SEQ ID NO: 216 - protein, 18 aa, Canis lupus familiaris
KAETENTGTVITREKNKN

SEQ ID NO: 217 - protein, 13 aa, Canis lupus familiaris
KAEVNQIFNGQTF

SEQ ID NO: 218 - protein, 32 aa, Canis lupus familiaris
KAFHVLKKEFTTLSQLMMPQMLPFCCVTRGDS

SEQ ID NO: 219 - protein, 8 aa, Canis lupus familiaris
KAFKKKLI

SEQ ID NO: 220 - protein, 9 aa, Canis lupus familiaris
KAFLGDHLS

SEQ ID NO: 221 - protein, 8 aa, Canis lupus familiaris
KAFPKILW

SEQ ID NO: 222 - protein, 15 aa, Canis lupus familiaris
KAFSASVPNASDHGI

SEQ ID NO: 223 - protein, 8 aa, Canis lupus familiaris
KAGEDNRS

SEQ ID NO: 224 - protein, 17 aa, Canis lupus familiaris
KAGGWSQVLEIWGCCHC

SEQ ID NO: 225 - protein, 11 aa, Canis lupus familiaris
KAGKEEECRRC

SEQ ID NO: 226 - protein, 14 aa, Canis lupus familiaris
KAGLLWWSSETGVI

SEQ ID NO: 227 - protein, 10 aa, Canis lupus familiaris
KAGLRVNSPT

SEQ ID NO: 228 - protein, 10 aa, Canis lupus familiaris
KAGPSRGQSR

SEQ ID NO: 229 - protein, 13 aa, Canis lupus familiaris
KAHCYRNVRCQTG

SEQ ID NO: 230 - protein, 40 aa, Canis lupus familiaris
KAHLQMHPLPWCIHQQHDRLDYHSASSSLQRCWKDPEWPG

SEQ ID NO: 231 - protein, 11 aa, Canis lupus familiaris
KAILQVKSTVC

SEQ ID NO: 232 - protein, 10 aa, Canis lupus familiaris
KAIWNSSKKN

SEQ ID NO: 233 - protein, 17 aa, Canis lupus familiaris
KAKAVKCAREELDQKRH

SEQ ID NO: 234 - protein, 13 aa, Canis lupus familiaris
KAKENGGKIYILS

SEQ ID NO: 235 - protein, 13 aa, Canis lupus familiaris
KAKKVKQVRILTS

SEQ ID NO: 236 - protein, 14 aa, Canis lupus familiaris
KALFGYPANKKESG

SEQ ID NO: 237 - protein, 15 aa, Canis lupus familiaris
KALHPYFVEERLLMT

SEQ ID NO: 238 - protein, 24 aa, Canis lupus familiaris
KALQPNHPHRDHGKGYHFLHGTGL

SEQ ID NO: 239 - protein, 36 aa, Canis lupus familiaris
KALQRGHVGELHKCHVSRKLERELQIPRRKIQIFRT

SEQ ID NO: 240 - protein, 25 aa, Canis lupus familiaris
KALRGFPDRPNHSHEDPRLLPTQPG

SEQ ID NO: 241 - protein, 28 aa, Canis lupus familiaris
KALRQHKFSLIFLKGVQLVRPHVHKYLT

SEQ ID NO: 242 - protein, 91 aa, Canis lupus familiaris
KALRVFLVVFLYPFHGHHFLRDVVLNQPPLLPSVLQQQPQNPQALRLCDIHYLDSAASRLQPTERRHLHNPHQCRGQQRQHVQEHRADEPR

SEQ ID NO: 243 - protein, 44 aa, Canis lupus familiaris
KALTPTLTILTRWQQNSFSSSTTRHSQWDSSLCLASMKNFLACW

SEQ ID NO: 244 - protein, 20 aa, Canis lupus familiaris
KALVPDWFLELTSQGKMAPL

SEQ ID NO: 245-246 - skipped (2 entries)

SEQ ID NO: 247 - protein, 29 aa, Canis lupus familiaris
KAMWFRKLLWNNRWSSAILQCTVKTQRKI

SEQ ID NO: 248 - protein, 19 aa, Canis lupus familiaris
KAMYQGHFIMDLLDYLYIA

SEQ ID NO: 249 - protein, 14 aa, Canis lupus familiaris
KAPQCCRRNGKGKV

SEQ ID NO: 250 - protein, 35 aa, Canis lupus familiaris
KAQDIRQDSAHQMPDGVGICYLHVLSQFICPWCSS

SEQ ID NO: 251 - protein, 8 aa, Canis lupus familiaris
KAQLISIF

SEQ ID NO: 252 - protein, 8 aa, Canis lupus familiaris
KAQNMLTS

SEQ ID NO: 253 - protein, 9 aa, Canis lupus familiaris
KAQRERSWT

SEQ ID NO: 254 - protein, 9 aa, Canis lupus familiaris
KAQWEALSS

SEQ ID NO: 255 - protein, 79 aa, Canis lupus familiaris
KARAEVVVMNEKEAKVRNGNEVEIEKGKRAKVAKGSEVGAKKGDGAAQEVEIADSEAATEVLTDDAPEAKVHSEKTRAP

SEQ ID NO: 256 - skipped

SEQ ID NO: 257 - protein, 9 aa, Canis lupus familiaris
KAREVRTSH

SEQ ID NO: 258 - protein, 24 aa, Canis lupus familiaris
KARFQATAGLLSFNTWTRKHQKSY

SEQ ID NO: 259 - protein, 11 aa, Canis lupus familiaris
KARGKTEPRVV

SEQ ID NO: 260 - protein, 26 aa, Canis lupus familiaris
KARHRRERPKGEGQRFGKKLQPEFKL

SEQ ID NO: 261 - protein, 84 aa, Canis lupus familiaris
KARIILGWRETRSLLCWRTQFPPKSRQSSSSSITGWGRWSTALWPCLLSCALEPPVLKISRWAACHQPSSRLPVARCTEDTCPL

SEQ ID NO: 262 - protein, 16 aa, Canis lupus familiaris
KASFTKTVFLHLLQKM

SEQ ID NO: 263 - protein, 24 aa, Canis lupus familiaris
KASMDQNTPNHALPALENPRLFLH

SEQ ID NO: 264 - protein, 11 aa, Canis lupus familiaris
KASSSHGLELS

SEQ ID NO: 265 - protein, 17 aa, Canis lupus familiaris
KASTEKINIITYCGYAP

SEQ ID NO: 266 - protein, 8 aa, Canis lupus familiaris
KASVLLFL

SEQ ID NO: 267 - protein, 45 aa, Canis lupus familiaris
KASVPLCSGFPGLVPIWNTHIHQDWESCTGNHSEFHGICYKFPSG

SEQ ID NO: 268 - protein, 27 aa, Canis lupus familiaris
KATNLKTIPLLAQEQLGVDPGMGTNGL

SEQ ID NO: 269 - protein, 30 aa, Canis lupus familiaris
KATPMAGPFISGPSLSSSQKLWESLPCTSI

SEQ ID NO: 270 - protein, 20 aa, Canis lupus familiaris
KATSMTHVDLKSASHTKSPN

SEQ ID NO: 271 - protein, 15 aa, Canis lupus familiaris
KAVCTHTDRLFLLSP

SEQ ID NO: 272 - protein, 30 aa, Canis lupus familiaris
KAVLCWKRQKTKSFGNCFRRRKKESPKRVP

SEQ ID NO: 273 - protein, 14 aa, Canis lupus familiaris
KAVLPSLRAVSRWQ

SEQ ID NO: 274 - skipped

SEQ ID NO: 275 - protein, 8 aa, Canis lupus familiaris
KAWSLGRD

SEQ ID NO: 276 - protein, 14 aa, Canis lupus familiaris
KCACTLIGRQGICC

SEQ ID NO: 277 - protein, 33 aa, Canis lupus familiaris
KCCFQHPDRWAHGRGDLGPGHSPHQGHLHLCQQ

SEQ ID NO: 278 - protein, 16 aa, Canis lupus familiaris
KCCPDFTLIWHGCDCC

SEQ ID NO: 279 - protein, 11 aa, Canis lupus familiaris
KCCWKPPRSQK

SEQ ID NO: 280 - protein, 23 aa, Canis lupus familiaris
KCCYLEIKYILFCWEKLFTTYVQ

SEQ ID NO: 281 - protein, 18 aa, Canis lupus familiaris
KCDFQIHKPNLQQTNKAS

SEQ ID NO: 282 - protein, 19 aa, Canis lupus familiaris
KCEAAHTRQHLLVQLGDRI

SEQ ID NO: 283 - protein, 19 aa, Canis lupus familiaris
KCELIYRLEKQRESSKTSD

SEQ ID NO: 284 - skipped

SEQ ID NO: 285 - protein, 49 aa, Canis lupus familiaris
KCFIKGKLHIIRPDLLSSFAPRGASLDILHGSAYHLLPRKPAQTVQKTF

SEQ ID NO: 286 - protein, 11 aa, Canis lupus familiaris
KCGITSTVFFL

SEQ ID NO: 287 - protein, 11 aa, Canis lupus familiaris
KCGPPKRRKSN

SEQ ID NO: 288 - skipped

SEQ ID NO: 289 - protein, 42 aa, Canis lupus familiaris
KCHQCLQMQQKNCSSEKEMQVWNDIHNPWWTCLERDMESCLL

SEQ ID NO: 290 - protein, 37 aa, Canis lupus familiaris
KCHSPSGPRNSYLPGPCRPGWATTLVGVPLCREAGKL

SEQ ID NO: 291 - protein, 14 aa, Canis lupus familiaris
KCICHDNDLQRVIP

SEQ ID NO: 292 - protein, 9 aa, Canis lupus familiaris
KCIMWTQTV

SEQ ID NO: 293 - skipped

SEQ ID NO: 294 - protein, 12 aa, Canis lupus familiaris
KCISYKRKAVRF

SEQ ID NO: 295 - protein, 22 aa, Canis lupus familiaris
KCKDSRNYFRSGLGRSGLATRI

SEQ ID NO: 296 - protein, 11 aa, Canis lupus familiaris
KCKFFWGLGSQ

SEQ ID NO: 297 - skipped

SEQ ID NO: 298 - protein, 24 aa, Canis lupus familiaris
KCKPGGRSNTRGKWSWQWRRCWPG

SEQ ID NO: 299 - protein, 8 aa, Canis lupus familiaris
KCLARSLF

SEQ ID NO: 300 - protein, 15 aa, Canis lupus familiaris
KCLCLVNHPKIQQKL

SEQ ID NO: 301 - protein, 17 aa, Canis lupus familiaris
KCLEARVAMNLVKPKPF

SEQ ID NO: 302 - protein, 14 aa, Canis lupus familiaris
KCLIGMSPENLLCH

SEQ ID NO: 303 - protein, 15 aa, Canis lupus familiaris
KCLINTCFPWPWRKM

SEQ ID NO: 304 - protein, 9 aa, Canis lupus familiaris
KCLKKLQSY

SEQ ID NO: 305 - protein, 9 aa, Canis lupus familiaris
KCLKMSCHV

SEQ ID NO: 306 - protein, 10 aa, Canis lupus familiaris
KCLQLLQLKE

SEQ ID NO: 307 - protein, 10 aa, Canis lupus familiaris
KCLSQCQNML

SEQ ID NO: 308 - protein, 19 aa, Canis lupus familiaris
KCLTNGKRNQMTWKMKSIS

SEQ ID NO: 309 - protein, 21 aa, Canis lupus familiaris
KCMRNLDNLLGKMQKKITGMD

SEQ ID NO: 310 - protein, 8 aa, Canis lupus familiaris
KCMSSSPK

SEQ ID NO: 311 - protein, 30 aa, Canis lupus familiaris
KCNCYLICIYKRLTGEAKVLVSGRKNASRT

SEQ ID NO: 312-313 - skipped (2 entries)

SEQ ID NO: 314 - protein, 15 aa, Canis lupus familiaris
KCPAFHITHNSYTKC

SEQ ID NO: 315 - protein, 25 aa, Canis lupus familiaris
KCPIVGNRHMRNGKIFSRKSSFYNN

SEQ ID NO: 316 - protein, 11 aa, Canis lupus familiaris
KCPRAKFIRSK

SEQ ID NO: 317 - skipped

SEQ ID NO: 318 - protein, 44 aa, Canis lupus familiaris
KCQMHWPFRWMLKEKLNMMQLLGKDSQKTRSFIASILTWFPRKS

SEQ ID NO: 319 - protein, 70 aa, Canis lupus familiaris
KCQMTRMTTRRNMAKRNMKKRLLQRKSSRMGKGKKGRKLWRPPWLLQRRRRKMMKNQTSMTLLWMMTDSP

SEQ ID NO: 320 - protein, 11 aa, Canis lupus familiaris
KCQTNNLNHLC

SEQ ID NO: 321 - protein, 13 aa, Canis lupus familiaris
KCRCCRRIRNTVL

SEQ ID NO: 322 - protein, 15 aa, Canis lupus familiaris
KCRGVPEAPRVDATP

SEQ ID NO: 323 - protein, 9 aa, Canis lupus familiaris
KCRGWHCCQ

SEQ ID NO: 324 - protein, 12 aa, Canis lupus familiaris
KCRLSYKDMQQE

SEQ ID NO: 325 - protein, 23 aa, Canis lupus familiaris
KCRPFCSFKGSTCYGKQQTRKQN

SEQ ID NO: 326 - protein, 10 aa, Canis lupus familiaris
KCRRRNFRRE

SEQ ID NO: 327 - protein, 19 aa, Canis lupus familiaris
KCSFPAFCRKCAEFSLQFL

SEQ ID NO: 328 - protein, 13 aa, Canis lupus familiaris
KCSHKQEEGTLRM

SEQ ID NO: 329 - protein, 17 aa, Canis lupus familiaris
KCSIPTLRTPCSLRRSA

SEQ ID NO: 330 - protein, 22 aa, Canis lupus familiaris
KCSREVDPCGWHCYCTLLSPQV

SEQ ID NO: 331 - protein, 75 aa, Canis lupus familiaris
KCSRKRWIHLMKCATAFSCSSVGSTISPCLQFECFLKCRKLVLIPMPLLMVIIIRLFWKAPGPQEVVVAIFFGQK

SEQ ID NO: 332 - protein, 9 aa, Canis lupus familiaris
KCSSGRQKQ

SEQ ID NO: 333 - protein, 12 aa, Canis lupus familiaris
KCSWGSSQSCWV

SEQ ID NO: 334 - protein, 13 aa, Canis lupus familiaris
KCTMVIYVSIKMF

SEQ ID NO: 335 - protein, 15 aa, Canis lupus familiaris
KCTPSSTLLQSVKEI

SEQ ID NO: 336 - protein, 59 aa, Canis lupus familiaris
KCTRGRKRNRTRIGSLGLEMLSRLMGRRITIRRFASIQKPWKWETVSLLFQMTLQNRCI

SEQ ID NO: 337 - protein, 17 aa, Canis lupus familiaris
KCTSVDIVTLRLQIHLF

SEQ ID NO: 338 - protein, 8 aa, Canis lupus familiaris
KCVCSDHK

SEQ ID NO: 339 - protein, 21 aa, Canis lupus familiaris
KCVIFVSIRIGYSISKFDHKS

SEQ ID NO: 340 - protein, 12 aa, Canis lupus familiaris
KCWKPLVNVLKV

SEQ ID NO: 341 - protein, 27 aa, Canis lupus familiaris
KCWNICSSSTILSLCGGSKVSAGRDDG

SEQ ID NO: 342 - protein, 35 aa, Canis lupus familiaris
KCYTLTPVTSIPTSSPPIQRGLCRLAGSSMCLAVH

SEQ ID NO: 343 - protein, 23 aa, Canis lupus familiaris
KDAEHNPSADPTASALQSAAGGP

SEQ ID NO: 344 - protein, 8 aa, Canis lupus familiaris
KDAPFPCG

SEQ ID NO: 345 - protein, 22 aa, Canis lupus familiaris
KDCCHGNSRCRSSFGLSLGKPF

SEQ ID NO: 346 - protein, 10 aa, Canis lupus familiaris
KDCLHSSSTI

SEQ ID NO: 347 - protein, 12 aa, Canis lupus familiaris
KDCPNLITFWIN

SEQ ID NO: 348 - protein, 22 aa, Canis lupus familiaris
KDDFGSHQILITKMTTSRLGVR

SEQ ID NO: 349 - protein, 18 aa, Canis lupus familiaris
KDEDDELRKSCKKKDQKN

SEQ ID NO: 350 - protein, 14 aa, Canis lupus familiaris
KDEKVKRRWSRGRK

SEQ ID NO: 351 - protein, 13 aa, Canis lupus familiaris
KDEVPSRRECSSV

SEQ ID NO: 352 - protein, 20 aa, Canis lupus familiaris
KDFHERLCCRIIQKISHLYM

SEQ ID NO: 353 - protein, 23 aa, Canis lupus familiaris
KDFKKTSEEKHLESTTNTKLLSS

SEQ ID NO: 354 - protein, 15 aa, Canis lupus familiaris
KDGKNQAAKKEGNEK

SEQ ID NO: 355 - protein, 13 aa, Canis lupus familiaris
KDGKRRGGSETQA

SEQ ID NO: 356 - protein, 14 aa, Canis lupus familiaris
KDGKRSKQIASLGC

SEQ ID NO: 357 - protein, 21 aa, Canis lupus familiaris
KDGRLNYSDVQYGRRYAESSI

SEQ ID NO: 358 - protein, 28 aa, Canis lupus familiaris
KDGRRRRVKGLPQGNKNLIKNQEPQLMR

SEQ ID NO: 359 - skipped

SEQ ID NO: 360 - protein, 29 aa, Canis lupus familiaris
KDGRRRRVKGLPQQGNKNLIKNQEPQLMR

SEQ ID NO: 361 - protein, 13 aa, Canis lupus familiaris
KDGVCIFIPNCHV

SEQ ID NO: 362 - protein, 21 aa, Canis lupus familiaris
KDHLLYWMFRPILFLFLFGNF

SEQ ID NO: 363 - protein, 8 aa, Canis lupus familiaris
KDHMSKTG

SEQ ID NO: 364 - protein, 27 aa, Canis lupus familiaris
KDILMKMPQRILKNMKVWNINLLKNPL

SEQ ID NO: 365 - protein, 21 aa, Canis lupus familiaris
KDILRHMAQTANQDPASIMFN

SEQ ID NO: 366 - protein, 31 aa, Canis lupus familiaris
KDIQASPLQEVTGPPRRCLTGLPPVVCRSCR

SEQ ID NO: 367 - protein, 24 aa, Canis lupus familiaris
KDIVGVDLQQLKLDGVEVEVTHAE

SEQ ID NO: 368 - protein, 42 aa, Canis lupus familiaris
KDIYVGEDTSALETLGGATILTPTTSSLLKNAKMPWGTPGRR

SEQ ID NO: 369 - protein, 8 aa, Canis lupus familiaris
KDKEKAIS

SEQ ID NO: 370 - protein, 22 aa, Canis lupus familiaris
KDKERERDEERRASTSNSTPSN

SEQ ID NO: 371 - protein, 8 aa, Canis lupus familiaris
KDKKSVSK

SEQ ID NO: 372 - protein, 30 aa, Canis lupus familiaris
KDKQPSDLKPTGVGPWLGRWPKGESGLCGP

SEQ ID NO: 373 - protein, 8 aa, Canis lupus familiaris
KDLIITFR

SEQ ID NO: 374 - protein, 8 aa, Canis lupus familiaris
KDLKSGKN

SEQ ID NO: 375 - protein, 37 aa, Canis lupus familiaris
KDLRLRIMCTCGRYITQIWDGCALMPPIQRRGTGCDM

SEQ ID NO: 376 - protein, 39 aa, Canis lupus familiaris
KDLYMLVQLSLKMKRKAKKCQRTFQKMKTLEFYKKIIKS

SEQ ID NO: 377 - protein, 32 aa, Canis lupus familiaris
KDMTMQICQRRKWEHQKILYMEIFLKNQIMLD

SEQ ID NO: 378 - protein, 20 aa, Canis lupus familiaris
KDNDSKAVSTGPGTRQAVNL

SEQ ID NO: 379 - protein, 33 aa, Canis lupus familiaris
KDPGVCYLYDGLCLWGPNSISAVHAHLSPGLYR

SEQ ID NO: 380 - protein, 44 aa, Canis lupus familiaris
KDPGVGICNTPGSCRPQNASDGTPGVCRYNSESGAFGGCPSFSV

SEQ ID NO: 381 - protein, 43 aa, Canis lupus familiaris
KDPVVLPEIRVCREEHEVPLRNAAFRNRYLQCSRTHLCSGTCR

SEQ ID NO: 382 - protein, 8 aa, Canis lupus familiaris
KDQLLKDF

SEQ ID NO: 383 - skipped

SEQ ID NO: 384 - protein, 8 aa, Canis lupus familiaris
KDQTTGES

SEQ ID NO: 385 - skipped

SEQ ID NO: 386 - protein, 19 aa, Canis lupus familiaris
KDRKKERENCIKCGPKIYV

SEQ ID NO: 387 - protein, 15 aa, Canis lupus familiaris
KDRRKTGPNCNREEF

SEQ ID NO: 388 - protein, 17 aa, Canis lupus familiaris
KDRSLFARRQEQIDRLG

SEQ ID NO: 389 - skipped

SEQ ID NO: 390 - protein, 12 aa, Canis lupus familiaris
KDSRLPTLTQKP

SEQ ID NO: 391 - protein, 11 aa, Canis lupus familiaris
KDSRTGETRDH

SEQ ID NO: 392 - protein, 17 aa, Canis lupus familiaris
KDSTESSDLGTERTAHR

SEQ ID NO: 393 - protein, 12 aa, Canis lupus familiaris
KDTRIPRISRWC

SEQ ID NO: 394 - protein, 27 aa, Canis lupus familiaris
KDVKTPAKIRYLYLSILYTYTNSSTKA

SEQ ID NO: 395 - skipped

SEQ ID NO: 396 - protein, 11 aa, Canis lupus familiaris
KDVRRKSFARG

SEQ ID NO: 397 - protein, 21 aa, Canis lupus familiaris
KDWDVVHVMRMKSKNISFFRK

SEQ ID NO: 398 - protein, 8 aa, Canis lupus familiaris
KDWRPQRN

SEQ ID NO: 399 - skipped

SEQ ID NO: 400 - protein, 22 aa, Canis lupus familiaris
KEAENSAVQGEEHTGPQDASDG

SEQ ID NO: 401 - skipped

SEQ ID NO: 402 - protein, 9 aa, Canis lupus familiaris
KEAKGIQLC

SEQ ID NO: 403 - protein, 11 aa, Canis lupus familiaris
KEAPERTPGIK

SEQ ID NO: 404 - protein, 14 aa, Canis lupus familiaris
KEAQQSKYRGFRLT

SEQ ID NO: 405 - protein, 12 aa, Canis lupus familiaris
KECDFKTPIKWS

SEQ ID NO: 406 - protein, 39 aa, Canis lupus familiaris
KECEDSQSAGPCPSYGQRLESWLPCTCILAKGKMCPLER

SEQ ID NO: 407 - protein, 9 aa, Canis lupus familiaris
KECIPSFFR

SEQ ID NO: 408 - protein, 18 aa, Canis lupus familiaris
KECSRSDCISSCWWINSP

SEQ ID NO: 409 - protein, 8 aa, Canis lupus familiaris
KECVPLWL

SEQ ID NO: 410 - protein, 13 aa, Canis lupus familiaris
KECYHSPEAVESW

SEQ ID NO: 411 - protein, 14 aa, Canis lupus familiaris
KEDCTTKSYDSQNS

SEQ ID NO: 412 - protein, 8 aa, Canis lupus familiaris
KEDHGFKK

SEQ ID NO: 413 - protein, 96 aa, Canis lupus familiaris
KEEEALTVTDRVQGRVPVGVPKQASHTSAHGPLSQHLSRGESGLQSGALQGSFSGKRRPDLLSNCLLCAEQNNSGPHGQSEGDARCFQEHADQCLL

SEQ ID NO: 414 - protein, 22 aa, Canis lupus familiaris
KEEEGYSHAAKGHHTCRTSSNT

SEQ ID NO: 415 - protein, 8 aa, Canis lupus familiaris
KEEETRGV

SEQ ID NO: 416 - protein, 8 aa, Canis lupus familiaris
KEEKEKMR

SEQ ID NO: 417 - protein, 9 aa, Canis lupus familiaris
KEEKKEENI

SEQ ID NO: 418 - protein, 12 aa, Canis lupus familiaris
KEEKKGEAFIHS

SEQ ID NO: 419 - protein, 14 aa, Canis lupus familiaris
KEELLFLLLLPQAC

SEQ ID NO: 420 - protein, 21 aa, Canis lupus familiaris
KEEQSRTWNGCVNNVEGNSLS

SEQ ID NO: 421 - protein, 27 aa, Canis lupus familiaris
KEESDGRENTWETCELQVVSASSLPVL

SEQ ID NO: 422 - protein, 8 aa, Canis lupus familiaris
KEESKKGL

SEQ ID NO: 423 - protein, 29 aa, Canis lupus familiaris
KEETLQRFSFSGCHDTKISEREGCIKEGA

SEQ ID NO: 424 - protein, 9 aa, Canis lupus familiaris
KEETLQVQN

SEQ ID NO: 425 - protein, 19 aa, Canis lupus familiaris
KEEVGRSYCCPGRCICCCI

SEQ ID NO: 426 - protein, 11 aa, Canis lupus familiaris
KEFKERCQEHR

SEQ ID NO: 427 - protein, 26 aa, Canis lupus familiaris
KEFPSFPSINMSVLYIDMMFSGTGVF

SEQ ID NO: 428 - protein, 29 aa, Canis lupus familiaris
KEFQIKKTMILLKMKNTEKKEWIIKGRKI

SEQ ID NO: 429 - protein, 24 aa, Canis lupus familiaris
KEFREGKTKLYRSSHSPRIGEKGV

SEQ ID NO: 430 - protein, 10 aa, Canis lupus familiaris
KEFSLIMKSE

SEQ ID NO: 431 - protein, 47 aa, Canis lupus familiaris
KEGAAGCRGGGQLPLHCRGPQSCTHREARSPSGPSMPAQPQPSDPGA

SEQ ID NO: 432 - protein, 17 aa, Canis lupus familiaris
KEGAVAAAVVQTPHVLS

SEQ ID NO: 433-434 - skipped (2 entries)

SEQ ID NO: 435 - protein, 14 aa, Canis lupus familiaris
KEGKPHVHPTFKLP

SEQ ID NO: 436 - protein, 62 aa, Canis lupus familiaris
KEGRGKGKNPIRKRVRTQYLTTKVWNPAEKPRNHEKTKTNSSRRSERSKINNRNRLWISFGD

SEQ ID NO: 437 - protein, 44 aa, Canis lupus familiaris
KEGVKRKCPQIRWLKCKQKLMRREKHLKQSLIWKKKKETRLELN

SEQ ID NO: 438 - protein, 10 aa, Canis lupus familiaris
KEHFVFVSIC

SEQ ID NO: 439 - protein, 30 aa, Canis lupus familiaris
KEHHEKRKRATAKQRNIKIKRRCKQTGNNK

SEQ ID NO: 440 - protein, 9 aa, Canis lupus familiaris
KEHMPLTFL

SEQ ID NO: 441 - protein, 9 aa, Canis lupus familiaris
KEHQSNQLC

SEQ ID NO: 442 - protein, 9 aa, Canis lupus familiaris
KEHTGSTEK

SEQ ID NO: 443 - protein, 50 aa, Canis lupus familiaris
KEICIMFNSMYKYSCLSIYAEAWLWYWGKCVPYEKISKRLVSFSLGCEKD

SEQ ID NO: 444 - protein, 17 aa, Canis lupus familiaris
KEICQNYKSATTTSKSF

SEQ ID NO: 445 - protein, 23 aa, Canis lupus familiaris
KEIFYYVVFLYITHRRSRTYRQV

SEQ ID NO: 446 - protein, 18 aa, Canis lupus familiaris
KEILLNLKMFQQTQKIIL

SEQ ID NO: 447 - protein, 22 aa, Canis lupus familiaris
KEILQDVYGGPCEGSHGNQYEK

SEQ ID NO: 448 - protein, 19 aa, Canis lupus familiaris
KEILVRYCAVGVVHAVVQN

SEQ ID NO: 449 - protein, 8 aa, Canis lupus familiaris
KEIPKTVF

SEQ ID NO: 450 - protein, 30 aa, Canis lupus familiaris
KEIQLTNPSNLFLVWLHRFQGYRDAYLRPD

SEQ ID NO: 451 - protein, 9 aa, Canis lupus familiaris
KEIRSYRNE

SEQ ID NO: 452 - protein, 12 aa, Canis lupus familiaris
KEIRTLKYPPRK

SEQ ID NO: 453 - skipped

SEQ ID NO: 454 - protein, 13 aa, Canis lupus familiaris
KEKEKRKEEQIRR

SEQ ID NO: 455 - protein, 12 aa, Canis lupus familiaris
KEKGIKMSRIVV

SEQ ID NO: 456 - protein, 23 aa, Canis lupus familiaris
KEKGKGNHERWKQTRRSMDKSIR

SEQ ID NO: 457 - protein, 17 aa, Canis lupus familiaris
KEKGNGLHQNFCLTNMM

SEQ ID NO: 458 - protein, 17 aa, Canis lupus familiaris
KEKGRHYTLLVTQIPLE

SEQ ID NO: 459 - protein, 16 aa, Canis lupus familiaris
KEKHLRLLPNSLWSLN

SEQ ID NO: 460 - protein, 20 aa, Canis lupus familiaris
KEKHRISSPKNLLPSGNRLP

SEQ ID NO: 461 - protein, 8 aa, Canis lupus familiaris
KEKKKKKG

SEQ ID NO: 462 - protein, 13 aa, Canis lupus familiaris
KEKQLTTLLTLRN

SEQ ID NO: 463 - protein, 12 aa, Canis lupus familiaris
KEKQRKGKNVPK

SEQ ID NO: 464 - protein, 64 aa, Canis lupus familiaris
KEKRRPPGNSSMRLGIVGHLYYPGGSVHVLSLKHPTKKWEQVTSLDLQITDLKIFLLILHLCLI

SEQ ID NO: 465 - skipped

SEQ ID NO: 466 - protein, 15 aa, Canis lupus familiaris
KEKTPNQALKNPKRK

SEQ ID NO: 467 - protein, 8 aa, Canis lupus familiaris
KEKTRKQR

SEQ ID NO: 468 - protein, 8 aa, Canis lupus familiaris
KEKVFLKI

SEQ ID NO: 469 - skipped

SEQ ID NO: 470 - protein, 13 aa, Canis lupus familiaris
KEKWSRFTQKLMD

SEQ ID NO: 471 - protein, 40 aa, Canis lupus familiaris
KELENTVKKTQEMKEQKIKSIMNQIQILKNLRSQDTDIGF

SEQ ID NO: 472 - protein, 33 aa, Canis lupus familiaris
KELKQLHPPPCSLLLKALIIPRTVSLVLTMQKT

SEQ ID NO: 473 - protein, 40 aa, Canis lupus familiaris
KELKQLHPPPCSLLLKALIIPRTVSLVLTMQRTCLVCLKV

SEQ ID NO: 474 - protein, 12 aa, Canis lupus familiaris
KELMISVSHVLC

SEQ ID NO: 475 - protein, 13 aa, Canis lupus familiaris
KELNPLIHLLLKN

SEQ ID NO: 476 - protein, 8 aa, Canis lupus familiaris
KELRGFLV

SEQ ID NO: 477 - skipped

SEQ ID NO: 478 - protein, 41 aa, Canis lupus familiaris
KELSPSYGSQASILLPTGLGRHWWILASLFFFSFQCFYFCM

SEQ ID NO: 479 - protein, 8 aa, Canis lupus familiaris
KELTGFPL

SEQ ID NO: 480-481 - skipped (2 entries)

SEQ ID NO: 482 - protein, 20 aa, Canis lupus familiaris
KEMSFLLYHCVLCFQGHSWK

SEQ ID NO: 483 - protein, 9 aa, Canis lupus familiaris
KEMSPKKKV

SEQ ID NO: 484 - protein, 17 aa, Canis lupus familiaris
KEMWKPSNKLSWRRISK

SEQ ID NO: 485 - protein, 10 aa, Canis lupus familiaris
KENAKMIFKK

SEQ ID NO: 486 - protein, 12 aa, Canis lupus familiaris
KENALARQKRRG

SEQ ID NO: 487 - protein, 9 aa, Canis lupus familiaris
KENAPGKVN

SEQ ID NO: 488 - protein, 19 aa, Canis lupus familiaris
KENFNRNQPKMEFRSRKRR

SEQ ID NO: 489 - protein, 14 aa, Canis lupus familiaris
KENGELPAQPKVVQ

SEQ ID NO: 490 - protein, 35 aa, Canis lupus familiaris
KENKILTHRRLGVLQEVIDQLLRRRVLREMGQGQH

SEQ ID NO: 491 - protein, 12 aa, Canis lupus familiaris
KENREARRETEK

SEQ ID NO: 492 - skipped

SEQ ID NO: 493 - protein, 13 aa, Canis lupus familiaris
KENSGSSVFYFPW

SEQ ID NO: 494 - protein, 11 aa, Canis lupus familiaris
KENTLKMIISK

SEQ ID NO: 495 - protein, 23 aa, Canis lupus familiaris
KENVAKQLQREAFCFNQNKSLLL

SEQ ID NO: 496 - protein, 18 aa, Canis lupus familiaris
KENVLLSPYLVLERRGQQ

SEQ ID NO: 497 - protein, 12 aa, Canis lupus familiaris
KEPHFMRTSLKQ

SEQ ID NO: 498 - protein, 57 aa, Canis lupus familiaris
KEPHPKSPGLPSSGGRKRPKLLSPWTMRMLSPKGKPRFTATPSETSLCFQWKIYLSQ

SEQ ID NO: 499 - protein, 19 aa, Canis lupus familiaris
KEQACVSASTLRPASCCQL

SEQ ID NO: 500 - protein, 28 aa, Canis lupus familiaris
KEQLMTFNKVNWKHLFRILVWPSMQKLS

SEQ ID NO: 501 - protein, 15 aa, Canis lupus familiaris
KEQQWRQLIWHEPHT

SEQ ID NO: 502 - protein, 13 aa, Canis lupus familiaris
KEQRKANCPTSYL

SEQ ID NO: 503 - protein, 11 aa, Canis lupus familiaris
KEQTRKRMEQN

SEQ ID NO: 504 - protein, 38 aa, Canis lupus familiaris
KERCILKINHYHLSPYQNQIILRRYEQKRRKAVKNEKK

SEQ ID NO: 505 - protein, 37 aa, Canis lupus familiaris
KERERQRQKERKDRKKDKERERDEERRASTSNSTPSN

SEQ ID NO: 506 - protein, 23 aa, Canis lupus familiaris
KERKIILNCFWEKTESPSIFTTY

SEQ ID NO: 507 - protein, 9 aa, Canis lupus familiaris
KERKIKETI

SEQ ID NO: 508 - protein, 43 aa, Canis lupus familiaris
KERKIQGMLKRILKRNCNLKKIPKKLSRQVSIVKRKRYLLQRI

SEQ ID NO: 509 - protein, 17 aa, Canis lupus familiaris
KERKNDKRKFEDVGGGK

SEQ ID NO: 510 - protein, 9 aa, Canis lupus familiaris
KERKQFSSV

SEQ ID NO: 511 - protein, 17 aa, Canis lupus familiaris
KERKTTRTEGKKRGISF

SEQ ID NO: 512 - protein, 18 aa, Canis lupus familiaris
KERLRAFRPGRENKVASH

SEQ ID NO: 513 - protein, 39 aa, Canis lupus familiaris
KERMASGETMTGTMSGMNCTVRNMTGEEAGVRVGVRAEA

SEQ ID NO: 514 - protein, 20 aa, Canis lupus familiaris
KERPTYHQMLKNFPHLLIPE

SEQ ID NO: 515 - protein, 19 aa, Canis lupus familiaris
KERRDHFPNTCVQNTNGHL

SEQ ID NO: 516 - protein, 10 aa, Canis lupus familiaris
KERRKEKKLS

SEQ ID NO: 517 - protein, 73 aa, Canis lupus familiaris
KERRLILKINLCLQNPHQNQIMKRKCKQKRREDMKSEKKQQKKQRRRRRGRRNSTRNIVRRRKRSRVQVTSQD

SEQ ID NO: 518 - protein, 9 aa, Canis lupus familiaris
KERRLQNAN

SEQ ID NO: 519 - protein, 8 aa, Canis lupus familiaris
KERRRQPG

SEQ ID NO: 520 - skipped

SEQ ID NO: 521 - protein, 10 aa, Canis lupus familiaris
KERTTYLPGI

SEQ ID NO: 522 - protein, 22 aa, Canis lupus familiaris
KERWMIRTPATMTAMVTKAMTT

SEQ ID NO: 523 - protein, 8 aa, Canis lupus familiaris
KERWRRTQ

SEQ ID NO: 524 - protein, 9 aa, Canis lupus familiaris
KERWRSRTQ

SEQ ID NO: 525 - protein, 25 aa, Canis lupus familiaris
KESGIARKISLGSPPTRATANGREK

SEQ ID NO: 526 - protein, 41 aa, Canis lupus familiaris
KESHSVLVGVLMRLTQKIKRKLVLLDQRLPSGSLIPEPQCV

SEQ ID NO: 527 - protein, 16 aa, Canis lupus familiaris
KESLFHVQEESGTYWV

SEQ ID NO: 528 - protein, 17 aa, Canis lupus familiaris
KESLILKGLEGRNLLGI

SEQ ID NO: 529 - protein, 9 aa, Canis lupus familiaris
KESMEEDGH

SEQ ID NO: 530 - protein, 8 aa, Canis lupus familiaris
KESPKRVP

SEQ ID NO: 531 - protein, 9 aa, Canis lupus familiaris
KESSDDSWN

SEQ ID NO: 532 - protein, 9 aa, Canis lupus familiaris
KESSRTTGS

SEQ ID NO: 533 - protein, 72 aa, Canis lupus familiaris
KESTQRGHRSLLKTLTAKMHPGRDSGPTSTVFGRERRSMTRQPEQAPARPSRQPPHSRARQQRNICQMHANH

SEQ ID NO: 534 - protein, 12 aa, Canis lupus familiaris
KESTRMILLMKN

SEQ ID NO: 535 - skipped

SEQ ID NO: 536 - protein, 9 aa, Canis lupus familiaris
KETCQLKKS

SEQ ID NO: 537 - protein, 10 aa, Canis lupus familiaris
KETGPGKETL

SEQ ID NO: 538 - protein, 9 aa, Canis lupus familiaris
KETGRIWLQ

SEQ ID NO: 539 - protein, 20 aa, Canis lupus familiaris
KETIYLRQSSQFLSNPATKS

SEQ ID NO: 540 - protein, 19 aa, Canis lupus familiaris
KETKEEKLQEFRCYQCETV

SEQ ID NO: 541 - protein, 11 aa, Canis lupus familiaris
KETKEKDGNSR

SEQ ID NO: 542 - protein, 8 aa, Canis lupus familiaris
KETKESIM

SEQ ID NO: 543 - protein, 10 aa, Canis lupus familiaris
KETKNAELQV

SEQ ID NO: 544 - skipped

SEQ ID NO: 545 - protein, 14 aa, Canis lupus familiaris
KETPQTVPGSEEKV

SEQ ID NO: 546 - protein, 15 aa, Canis lupus familiaris
KETRHPKRPKEEGCG

SEQ ID NO: 547 - protein, 10 aa, Canis lupus familiaris
KETRKSWTTG

SEQ ID NO: 548 - protein, 15 aa, Canis lupus familiaris
KETSNSVCLAKLWRG

SEQ ID NO: 549 - protein, 26 aa, Canis lupus familiaris
KETTESTSRCHCYRATKCEMERCCWS

SEQ ID NO: 550 - protein, 22 aa, Canis lupus familiaris
KETTPDCGPSHTAPYRAGRKAV

SEQ ID NO: 551 - protein, 14 aa, Canis lupus familiaris
KEVHSTPGGSQPEE

SEQ ID NO: 552 - protein, 15 aa, Canis lupus familiaris
KEVIYSHHRRSKHTS

SEQ ID NO: 553 - protein, 11 aa, Canis lupus familiaris
KEVPSGARDHV

SEQ ID NO: 554 - protein, 8 aa, Canis lupus familiaris
KEVRQQTT

SEQ ID NO: 555 - protein, 18 aa, Canis lupus familiaris
KEVWRSRHLHDRRTEEIL

SEQ ID NO: 556 - protein, 10 aa, Canis lupus familiaris
KEWIIKGRKI

SEQ ID NO: 557 - protein, 15 aa, Canis lupus familiaris
KEWQPPNSVLGRFLS

SEQ ID NO: 558 - protein, 19 aa, Canis lupus familiaris
KEWSVKSARAVGKRIALWT

SEQ ID NO: 559 - protein, 9 aa, Canis lupus familiaris
KEWVTIRSF

SEQ ID NO: 560 - protein, 15 aa, Canis lupus familiaris
KFCKHKCSRCHYGSG

SEQ ID NO: 561 - protein, 53 aa, Canis lupus familiaris
KFCKTTPLLPFMICVPLSQPRSCLLTCTWLLECTIQLTRKVTILCLRYWEPLS

SEQ ID NO: 562 - protein, 21 aa, Canis lupus familiaris
KFCMGNSVEFFPSNNLHSKGE

SEQ ID NO: 563 - protein, 14 aa, Canis lupus familiaris
KFCNVLNVIRHLTA

SEQ ID NO: 564 - protein, 21 aa, Canis lupus familiaris
KFCSIMMNKIRNNPIHPWYWT

SEQ ID NO: 565 - protein, 23 aa, Canis lupus familiaris
KFCVQIIYSKRTCVTALWTEFYL

SEQ ID NO: 566 - protein, 17 aa, Canis lupus familiaris
KFCWTNSGVCSIVQLPL

SEQ ID NO: 567 - protein, 30 aa, Canis lupus familiaris
KFDCNVSVRKMSTRGSKEGRAASLYRKGQS

SEQ ID NO: 568 - protein, 14 aa, Canis lupus familiaris
KFDTEADYFESSAP

SEQ ID NO: 569 - protein, 8 aa, Canis lupus familiaris
KFEKDNGG

SEQ ID NO: 570 - protein, 18 aa, Canis lupus familiaris
KFENLDHFPRKHLKSTRH

SEQ ID NO: 571 - protein, 15 aa, Canis lupus familiaris
KFFETSNLEIPSMML

SEQ ID NO: 572 - protein, 14 aa, Canis lupus familiaris
KFFNIVFRNCKTKK

SEQ ID NO: 573 - protein, 11 aa, Canis lupus familiaris
KFFTTYANRKF

SEQ ID NO: 574 - protein, 25 aa, Canis lupus familiaris
KFGLESACFWWRCVRGSLSLKLSAI

SEQ ID NO: 575 - protein, 19 aa, Canis lupus familiaris
KFGLSRTARAQTGACRAAY

SEQ ID NO: 576 - protein, 14 aa, Canis lupus familiaris
KFGSKYERMDLAVC

SEQ ID NO: 577 - protein, 9 aa, Canis lupus familiaris
KFHTKVATQ

SEQ ID NO: 578 - protein, 16 aa, Canis lupus familiaris
KFHYSRHNCLYRRENN

SEQ ID NO: 579 - protein, 15 aa, Canis lupus familiaris
KFIISLSSTLLPDSL

SEQ ID NO: 580 - protein, 23 aa, Canis lupus familiaris
KFIMNRSKLFKNLATNLANQNLK

SEQ ID NO: 581 - protein, 28 aa, Canis lupus familiaris
KFISLSVDYIGYTGKMSCWATKGHDEIR

SEQ ID NO: 582 - skipped

SEQ ID NO: 583 - protein, 22 aa, Canis lupus familiaris
KFITQVTRLHTLMAFELTALII

SEQ ID NO: 584 - protein, 8 aa, Canis lupus familiaris
KFITSKMK

SEQ ID NO: 585 - protein, 49 aa, Canis lupus familiaris
KFIYVNTVRNSLTTLDILKSIFGNIQVKNLLNVQIVMNDLLEIAPSNVT

SEQ ID NO: 586 - protein, 8 aa, Canis lupus familiaris
KFKEVDTQ

SEQ ID NO: 587 - protein, 27 aa, Canis lupus familiaris
KFKFKFLYNTFFGNSHSLNKSETSTSN

SEQ ID NO: 588 - protein, 8 aa, Canis lupus familiaris
KFKKQHLT

SEQ ID NO: 589 - protein, 17 aa, Canis lupus familiaris
KFKLEPILQRRVSASWK

SEQ ID NO: 590 - protein, 15 aa, Canis lupus familiaris
KFKNVNSRSNESPRS

SEQ ID NO: 591 - protein, 30 aa, Canis lupus familiaris
KFLFLQRSLGNHHKYAALQLKAENLSGSHQ

SEQ ID NO: 592 - protein, 15 aa, Canis lupus familiaris
KFLFQWILMTGMKFL

SEQ ID NO: 593 - protein, 15 aa, Canis lupus familiaris
KFLLVAFLQIHLKKK

SEQ ID NO: 594 - protein, 11 aa, Canis lupus familiaris
KFLLYVSYTVS

SEQ ID NO: 595 - protein, 29 aa, Canis lupus familiaris
KFLNAKPNLDRSEKRKANIRKNLLRKCRS

SEQ ID NO: 596 - protein, 20 aa, Canis lupus familiaris
KFLVSQTSLNRSYSYSRSHC

SEQ ID NO: 597 - protein, 17 aa, Canis lupus familiaris
KFLWLAGCVGGTRRFYS

SEQ ID NO: 598 - protein, 13 aa, Canis lupus familiaris
KFMILQTSQKNQS

SEQ ID NO: 599 - protein, 51 aa, Canis lupus familiaris
KFMINLLGREKVMKRSIWMYLIIIMPQKHHGILSFLMLQKTFQISQLQMLS

SEQ ID NO: 600 - protein, 45 aa, Canis lupus familiaris
KFMQMQFLLFLLKKTRTLWFHRKQPTIQRTWKTVQVSLVKDKGLG

SEQ ID NO: 601 - protein, 24 aa, Canis lupus familiaris
KFMWIIADPRILLCLHCPLLLLLV

SEQ ID NO: 602 - protein, 56 aa, Canis lupus familiaris
KFPAHRQRSGRTCKSWIPSSSLLCLCLLTQGLAVRGGCRSLQRAVAGVPGCLESSA

SEQ ID NO: 603 - protein, 17 aa, Canis lupus familiaris
KFPDRTTFQNIIRPFMM

SEQ ID NO: 604 - protein, 19 aa, Canis lupus familiaris
KFPEVARDSDFPFTSKGDQ

SEQ ID NO: 605 - protein, 26 aa, Canis lupus familiaris
KFPLGQRPQMSWLERWIVWTAPLLPL

SEQ ID NO: 606 - skipped

SEQ ID NO: 607 - protein, 16 aa, Canis lupus familiaris
KFPTTLAPCSSGRQAS

SEQ ID NO: 608 - protein, 8 aa, Canis lupus familiaris
KFPVMSTS

SEQ ID NO: 609 - protein, 11 aa, Canis lupus familiaris
KFQALLLLWTK

SEQ ID NO: 610 - protein, 23 aa, Canis lupus familiaris
KFQEIITLSSPRQAFHLALTSVQ

SEQ ID NO: 611 - protein, 11 aa, Canis lupus familiaris
KFQIKQNSVSG

SEQ ID NO: 612 - protein, 32 aa, Canis lupus familiaris
KFQILSHRYNRYLLLKASSQNTERIFEPLESI

SEQ ID NO: 613 - protein, 13 aa, Canis lupus familiaris
KFQKRRKTFFSSS

SEQ ID NO: 614 - protein, 12 aa, Canis lupus familiaris
KFQKRWLSLVQE

SEQ ID NO: 615 - protein, 21 aa, Canis lupus familiaris
KFQLPWLLPSSIKKCSCSIII

SEQ ID NO: 616 - protein, 9 aa, Canis lupus familiaris
KFQNILSYN

SEQ ID NO: 617 - protein, 26 aa, Canis lupus familiaris
KFQVERSLILWLSMDLFVPKILHIKR

SEQ ID NO: 618 - protein, 17 aa, Canis lupus familiaris
KFRCAIEKSFENTSRYG

SEQ ID NO: 619 - protein, 8 aa, Canis lupus familiaris
KFRDYRTP

SEQ ID NO: 620 - protein, 8 aa, Canis lupus familiaris
KFRFLPNL

SEQ ID NO: 621 - skipped

SEQ ID NO: 622 - protein, 81 aa, Canis lupus familiaris
KFRRKAMGHQMDFMRKLIGKDITPLSWMKKATASDLRNPALPKESTFILQANRKRKKNHTRNLTSRLSHCNLKTFLRMLQP

SEQ ID NO: 623 - protein, 31 aa, Canis lupus familiaris
KFRSPHLLLPQPQREDPARHNCSGLVDLLTY

SEQ ID NO: 624 - protein, 12 aa, Canis lupus familiaris
KFSCHTINTLYI

SEQ ID NO: 625 - protein, 13 aa, Canis lupus familiaris
KFSEETSGNSQTE

SEQ ID NO: 626 - protein, 9 aa, Canis lupus familiaris
KFSILPSSR

SEQ ID NO: 627 - protein, 11 aa, Canis lupus familiaris
KFSLCDGPLQN

SEQ ID NO: 628 - protein, 13 aa, Canis lupus familiaris
KFSLERKGMNLRP

SEQ ID NO: 629 - protein, 22 aa, Canis lupus familiaris
KFSNKVTTSHLSAQLMKLMYLQ

SEQ ID NO: 630 - protein, 13 aa, Canis lupus familiaris
KFSRLTTWKIKLI

SEQ ID NO: 631 - protein, 11 aa, Canis lupus familiaris
KFSSAESDCIL

SEQ ID NO: 632 - protein, 9 aa, Canis lupus familiaris
KFSYASAVY

SEQ ID NO: 633 - protein, 13 aa, Canis lupus familiaris
KFSYFLLHLCWIS

SEQ ID NO: 634 - protein, 19 aa, Canis lupus familiaris
KFTFKGLSHPLSGVFALPP

SEQ ID NO: 635 - protein, 67 aa, Canis lupus familiaris
KFTFPRKRSGAQTSFSITMQMVTLPLSSSPKCSWTTRATSHGHLRPSSKATVRSLSPTFPLMNRTAA

SEQ ID NO: 636 - protein, 33 aa, Canis lupus familiaris
KFTILERDLIQLKGILMHLWSDEVGFINRTVLA

SEQ ID NO: 637 - protein, 15 aa, Canis lupus familiaris
KFTLLSTVSHWERSY

SEQ ID NO: 638 - protein, 18 aa, Canis lupus familiaris
KFTNVRSVGKHVFLIQRL

SEQ ID NO: 639 - protein, 12 aa, Canis lupus familiaris
KFVILLQSWPGI

SEQ ID NO: 640 - protein, 28 aa, Canis lupus familiaris
KFWIVCSGEEGWIEKKAAARGRAAKSKN

SEQ ID NO: 641 - protein, 23 aa, Canis lupus familiaris
KFWKLLQQHQKILARWLLLFKAR

SEQ ID NO: 642 - protein, 29 aa, Canis lupus familiaris
KFWRPRKIMRSYSGHPDLERRAATGTNLV

SEQ ID NO: 643 - protein, 36 aa, Canis lupus familiaris
KFWRPRKIMRSYSGHPDLERRRNCLSLSQHGRRRRT

SEQ ID NO: 644 - protein, 26 aa, Canis lupus familiaris
KGAGGQLWGGAGVCGGGGRGGSSLRQ

SEQ ID NO: 645 - protein, 18 aa, Canis lupus familiaris
KGARTSCWGCSRASTKAS

SEQ ID NO: 646 - skipped

SEQ ID NO: 647 - protein, 50 aa, Canis lupus familiaris
KGASRNEKESAGRGAERESPILRQATVHSWTGAQVQKLLPGGGPGTLQCI

SEQ ID NO: 648 - protein, 33 aa, Canis lupus familiaris
KGAYALMPAAGGQLWGGAGVCGGGGRGGSSLRQ

SEQ ID NO: 649 - skipped

SEQ ID NO: 650 - protein, 22 aa, Canis lupus familiaris
KGDHAGLWPLAHCPLQSRKESG

SEQ ID NO: 651 - protein, 44 aa, Canis lupus familiaris
KGDMTFSASVLSTFQSLLMKSTRSSAETSVPRHFLAQRTQKSLT

SEQ ID NO: 652 - protein, 34 aa, Canis lupus familiaris
KGDRNWRVILKVMVNFRTERKFEWRWSRGKRQCP

SEQ ID NO: 653 - protein, 13 aa, Canis lupus familiaris
KGEDINQLIINIL

SEQ ID NO: 654 - protein, 14 aa, Canis lupus familiaris
KGEDINQLIINILW

SEQ ID NO: 655 - protein, 16 aa, Canis lupus familiaris
KGEDTNRRMFQQEGIN

SEQ ID NO: 656 - protein, 42 aa, Canis lupus familiaris
KGEEDKAAEKRGGRWGTKAGRTEVVSHSASDLGPGGRGTCVL

SEQ ID NO: 657 - protein, 41 aa, Canis lupus familiaris
KGEEDKAAEKRGGRWGTKGRTEVVSHSASDLGPGGRGTCVL

SEQ ID NO: 658 - protein, 16 aa, Canis lupus familiaris
KGEEEKEGKEKEAQET

SEQ ID NO: 659 - protein, 8 aa, Canis lupus familiaris
KGEGKGEP

SEQ ID NO: 660 - protein, 57 aa, Canis lupus familiaris
KGEGMKNSPLKNLLVAITTRPKSLPSSLMMHLLLAPRRSTYPSSSLMLVAEKYGLAL

SEQ ID NO: 661 - protein, 11 aa, Canis lupus familiaris
KGEGSKTNLPL

SEQ ID NO: 662 - protein, 9 aa, Canis lupus familiaris
KGENCIWSY

SEQ ID NO: 663 - protein, 35 aa, Canis lupus familiaris
KGENKKTKMKHYHHHHLLNSALLSAKWLTFSIVIS

SEQ ID NO: 664 - protein, 17 aa, Canis lupus familiaris
KGENNLPTWNLKNFRKF

SEQ ID NO: 665 - protein, 13 aa, Canis lupus familiaris
KGETWEKSVHDCS

SEQ ID NO: 666 - protein, 8 aa, Canis lupus familiaris
KGFHTSII

SEQ ID NO: 667 - protein, 12 aa, Canis lupus familiaris
KGFIEVAFWRLH

SEQ ID NO: 668 - protein, 19 aa, Canis lupus familiaris
KGFLSQQMWSDVADSDLVP

SEQ ID NO: 669 - protein, 17 aa, Canis lupus familiaris
KGFTDPSGIFRISNKTT

SEQ ID NO: 670 - protein, 25 aa, Canis lupus familiaris
KGGAISCLSCRGFCSFWCTNWRSSF

SEQ ID NO: 671 - protein, 28 aa, Canis lupus familiaris
KGGATILTPTTSSLLKNAKMPWGTPGRR

SEQ ID NO: 672 - protein, 15 aa, Canis lupus familiaris
KGGDSRDSSWPPGQH

SEQ ID NO: 673 - protein, 27 aa, Canis lupus familiaris
KGGEGGRMSKVLTSSFLTEINHLIMLL

SEQ ID NO: 674 - skipped

SEQ ID NO: 675 - protein, 11 aa, Canis lupus familiaris
KGGGGEGRRMF

SEQ ID NO: 676 - protein, 26 aa, Canis lupus familiaris
KGGHEQSKFGGYKALDNKTSNGNPWV

SEQ ID NO: 677 - protein, 19 aa, Canis lupus familiaris
KGGKAQMVWHQRDSTDGLY

SEQ ID NO: 678 - protein, 21 aa, Canis lupus familiaris
KGGKTFHHGLRFAQQHSIPTG

SEQ ID NO: 679 - skipped

SEQ ID NO: 680 - protein, 16 aa, Canis lupus familiaris
KGGNEPQPVPGSESQV

SEQ ID NO: 681 - protein, 46 aa, Canis lupus familiaris
KGGPHSLLPSTYFSTLKTHNLENLEGAPGDPGSGKQSWYLLSSHRL

SEQ ID NO: 682 - protein, 9 aa, Canis lupus familiaris
KGGSPLVVV

SEQ ID NO: 683 - protein, 14 aa, Canis lupus familiaris
KGGVELTANPRGDL

SEQ ID NO: 684 - protein, 33 aa, Canis lupus familiaris
KGHCDHSLTHEFLCGHVLFGLHCLLFFKNVVEQ

SEQ ID NO: 685 - protein, 93 aa, Canis lupus familiaris
KGHRARQAARYLLFNRHCVVGRHNCNGCWPDWKLPGLHSGPHSPGDSTGCPWSAIWVHFSFLSSEGKAQYLGQIGVSAKLCRFCCADYPLPKI

SEQ ID NO: 686 - protein, 39 aa, Canis lupus familiaris
KGHSSSAPAPHQVPEAVPPHASHEPGGGGALVLSPGEYH

SEQ ID NO: 687 - protein, 20 aa, Canis lupus familiaris
KGINFCGKNNSSTVKCWFCY

SEQ ID NO: 688 - skipped

SEQ ID NO: 689 - protein, 12 aa, Canis lupus familiaris
KGIQQSSQEILL

SEQ ID NO: 690 - protein, 13 aa, Canis lupus familiaris
KGISCWHLKQPKV

SEQ ID NO: 691 - protein, 63 aa, Canis lupus familiaris
KGITLCKADQAKVHPMQRQRKIHLLKNPLIIITRNVGKEKTKQQILIIFMTGNHEQVTKLSVV

SEQ ID NO: 692 - protein, 45 aa, Canis lupus familiaris
KGITLIMFYYSVGSGSTHMHKELLFQRAYVCPITPPVLLRIFCLT

SEQ ID NO: 693 - protein, 63 aa, Canis lupus familiaris
KGITLRKADQAKVHPMQRQRKIHLLKNPLIIITRNVGKEKTKQQILIIFMTGNHKQVTKLSVV

SEQ ID NO: 694 - protein, 14 aa, Canis lupus familiaris
KGKADTVPASTSTG

SEQ ID NO: 695 - protein, 23 aa, Canis lupus familiaris
KGKCFGKAKKKGINPNLLKYGKN

SEQ ID NO: 696 - protein, 15 aa, Canis lupus familiaris
KGKEEEGKKGLNQRP

SEQ ID NO: 697 - protein, 18 aa, Canis lupus familiaris
KGKEMKKIKKFLQPNQQE

SEQ ID NO: 698 - skipped

SEQ ID NO: 699 - protein, 11 aa, Canis lupus familiaris
KGKGHEGNKRG

SEQ ID NO: 700 - protein, 17 aa, Canis lupus familiaris
KGKGRYCSSIDKHWLSS

SEQ ID NO: 701 - protein, 9 aa, Canis lupus familiaris
KGKHQTDTL

SEQ ID NO: 702 - protein, 15 aa, Canis lupus familiaris
KGKKKRKKAQLISIF

SEQ ID NO: 703 - protein, 16 aa, Canis lupus familiaris
KGKLGAIVPRVVKTLI

SEQ ID NO: 704 - protein, 8 aa, Canis lupus familiaris
KGKQKISG

SEQ ID NO: 705-706 - skipped (2 entries)

SEQ ID NO: 707 - protein, 9 aa, Canis lupus familiaris
KGKRRKRRD

SEQ ID NO: 708 - protein, 19 aa, Canis lupus familiaris
KGKRVAQRLYLKVFLAHHH

SEQ ID NO: 709 - protein, 10 aa, Canis lupus familiaris
KGKTLMKMIS

SEQ ID NO: 710 - protein, 9 aa, Canis lupus familiaris
KGKTSDRHL

SEQ ID NO: 711 - skipped

SEQ ID NO: 712 - protein, 15 aa, Canis lupus familiaris
KGKYSFFNYVWPCWL

SEQ ID NO: 713 - protein, 8 aa, Canis lupus familiaris
KGLCHMIE

SEQ ID NO: 714 - protein, 11 aa, Canis lupus familiaris
KGLCLFRRHRL

SEQ ID NO: 715 - protein, 26 aa, Canis lupus familiaris
KGLETSLPWRSNPLFQRSHCQFCLGA

SEQ ID NO: 716 - protein, 8 aa, Canis lupus familiaris
KGLFWIIR

SEQ ID NO: 717 - protein, 11 aa, Canis lupus familiaris
KGLGSWIWLCI

SEQ ID NO: 718 - protein, 15 aa, Canis lupus familiaris
KGLLLILEQLGNLED

SEQ ID NO: 719 - protein, 73 aa, Canis lupus familiaris
KGLQCIVRCSRPRAISVCLNRSCDWNHSDCRHLCGGPLHHQEMPQKQQNSQTEAKYRALQFRQHNKSIHEVNL

SEQ ID NO: 720 - skipped

SEQ ID NO: 721 - protein, 23 aa, Canis lupus familiaris
KGLYKSAAFHRPDFPVLPSISAW

SEQ ID NO: 722 - protein, 29 aa, Canis lupus familiaris
KGNGFMMNRRIFLAQECGEQYSPQIPKIK

SEQ ID NO: 723 - protein, 28 aa, Canis lupus familiaris
KGNGFMMNRRIFLAQECGEYSPQIPKIK

SEQ ID NO: 724 - skipped

SEQ ID NO: 725 - protein, 21 aa, Canis lupus familiaris
KGNTANGPGIGRKSLMPMQVT

SEQ ID NO: 726-727 - skipped (2 entries)

SEQ ID NO: 728 - protein, 11 aa, Canis lupus familiaris
KGPKPAAPSPQ

SEQ ID NO: 729 - protein, 14 aa, Canis lupus familiaris
KGQEKEKFTSTIAY

SEQ ID NO: 730 - protein, 26 aa, Canis lupus familiaris
KGQKLICQTTRTNRSSGMKRRTGGWM

SEQ ID NO: 731 - skipped

SEQ ID NO: 732 - protein, 13 aa, Canis lupus familiaris
KGQPQPHRKKKKV

SEQ ID NO: 733 - protein, 14 aa, Canis lupus familiaris
KGQRGDNPQHQSEK

SEQ ID NO: 734 - protein, 15 aa, Canis lupus familiaris
KGQRGLRKNRRKGEK

SEQ ID NO: 735 - protein, 24 aa, Canis lupus familiaris
KGRAAKCYGGKAGEPGGSAPPGLL

SEQ ID NO: 736 - protein, 14 aa, Canis lupus familiaris
KGRCYQLPQLQGFL

SEQ ID NO: 737 - protein, 61 aa, Canis lupus familiaris
KGRESSNGLAPARQYRRIILVIWMNLPPSLGQSPISRGCSSQIPNWLWRFSLALAAHTNLG

SEQ ID NO: 738 - protein, 15 aa, Canis lupus familiaris
KGRFHSRCEANIFKC

SEQ ID NO: 739 - skipped

SEQ ID NO: 740 - protein, 9 aa, Canis lupus familiaris
KGRGPRETR

SEQ ID NO: 741 - protein, 10 aa, Canis lupus familiaris
KGRKQSQRTA

SEQ ID NO: 742 - protein, 52 aa, Canis lupus familiaris
KGRRAENETGRGRKIPRRAGEGEGTDSEGQRQAARPDPPAAAAPGEGKGEPK

SEQ ID NO: 743 - protein, 13 aa, Canis lupus familiaris
KGRRRTECGARRS

SEQ ID NO: 744 - protein, 34 aa, Canis lupus familiaris
KGRSWKKLLLPGPLHLLLHLGGSAPKPYGIGSEN

SEQ ID NO: 745 - protein, 12 aa, Canis lupus familiaris
KGSDDWRKLARS

SEQ ID NO: 746 - skipped

SEQ ID NO: 747 - protein, 15 aa, Canis lupus familiaris
KGSLIYATIVFSEAN

SEQ ID NO: 748 - protein, 10 aa, Canis lupus familiaris
KGSLLYFSSE

SEQ ID NO: 749 - protein, 21 aa, Canis lupus familiaris
KGSLNLSQSPKRRKSPPQELL

SEQ ID NO: 750 - protein, 22 aa, Canis lupus familiaris
KGSPAPSALLSWRWMKLKPGRL

SEQ ID NO: 751 - protein, 59 aa, Canis lupus familiaris
KGSPNPQNEIQYLPVQRDKVATISSHRTPPDTRKLDMDPVTANTGNPVSVRPATVKDNH

SEQ ID NO: 752 - protein, 21 aa, Canis lupus familiaris
KGSRAPSKIEEGGQKARSQKA

SEQ ID NO: 753 - protein, 13 aa, Canis lupus familiaris
KGSTATQLSLLPL

SEQ ID NO: 754 - protein, 12 aa, Canis lupus familiaris
KGSTQYAWGITA

SEQ ID NO: 755 - protein, 9 aa, Canis lupus familiaris
KGSTRAWKI

SEQ ID NO: 756 - protein, 24 aa, Canis lupus familiaris
KGSWFLDLVMYLNPFWNTCQEITG

SEQ ID NO: 757 - protein, 8 aa, Canis lupus familiaris
KGTANGAL

SEQ ID NO: 758 - protein, 18 aa, Canis lupus familiaris
KGVLPCPLSQRTAPACPS

SEQ ID NO: 759 - skipped

SEQ ID NO: 760 - protein, 25 aa, Canis lupus familiaris
KGVPASDIQAEEREWQICSLETGSR

SEQ ID NO: 761 - protein, 12 aa, Canis lupus familiaris
KGVRIMRCLKPG

SEQ ID NO: 762 - protein, 9 aa, Canis lupus familiaris
KGWKKKRRQ

SEQ ID NO: 763 - protein, 8 aa, Canis lupus familiaris
KGWLKALC

SEQ ID NO: 764 - protein, 42 aa, Canis lupus familiaris
KGYRNLRKAIEKKEVWPVKRIIQTLTKRRKKKRVLQKEKTMN

SEQ ID NO: 765 - protein, 15 aa, Canis lupus familiaris
KHARRGETEKKRREH

SEQ ID NO: 766 - protein, 17 aa, Canis lupus familiaris
KHCHCYFSGPAFQALPH

SEQ ID NO: 767 - protein, 10 aa, Canis lupus familiaris
KHCRCDGIFN

SEQ ID NO: 768 - protein, 27 aa, Canis lupus familiaris
KHCRPHDPGWGGRAGGGEQDPCHTEEL

SEQ ID NO: 769 - protein, 9 aa, Canis lupus familiaris
KHCWSQHHD

SEQ ID NO: 770 - protein, 39 aa, Canis lupus familiaris
KHDCFNSYHSSLFGFVLKPKWRSDQADWRCLACVMHNIC

SEQ ID NO: 771 - protein, 25 aa, Canis lupus familiaris
KHDSKEDHGVPTYHPHLCNYRRRNR

SEQ ID NO: 772 - protein, 20 aa, Canis lupus familiaris
KHELWWMCGPALCGYGVGIL

SEQ ID NO: 773 - protein, 11 aa, Canis lupus familiaris
KHERCERQIGK

SEQ ID NO: 774 - protein, 8 aa, Canis lupus familiaris
KHEWQAQA

SEQ ID NO: 775 - protein, 20 aa, Canis lupus familiaris
KHGNNETNFHIKSKPFVCNI

SEQ ID NO: 776 - protein, 12 aa, Canis lupus familiaris
KHGPHRKTHLPK

SEQ ID NO: 777 - protein, 35 aa, Canis lupus familiaris
KHGRILALSFWIIIFMKKILIFPATGRFSLKFLMG

SEQ ID NO: 778 - protein, 28 aa, Canis lupus familiaris
KHGSRIRYYSKSSVAQGWRIKYIYKRRC

SEQ ID NO: 779 - protein, 32 aa, Canis lupus familiaris
KHHIGGTTRILTFLVVCILGSLLCSSRKTGNM

SEQ ID NO: 780 - protein, 26 aa, Canis lupus familiaris
KHHIGRTAWVFALVVVCILGPLLCSS

SEQ ID NO: 781 - protein, 19 aa, Canis lupus familiaris
KHKGYAHQKKPHFTSYTCL

SEQ ID NO: 782 - protein, 19 aa, Canis lupus familiaris
KHKWLKFCLLLAEKESSPE

SEQ ID NO: 783 - protein, 90 aa, Canis lupus familiaris
KHLCLQKGLLLGQAPRLTKCLLLKKLPRLLVSRPPSLHPSQQAETRPERLLVPLIQKKQLGPNHQLHHLLPPPHLVPELRRRHSLAKQGQ

SEQ ID NO: 784 - protein, 73 aa, Canis lupus familiaris
KHLKRNEKNKKNENNKSESKSFSKGKRSLKKSRKSSSVPIFPFHSGGGQFFKNQFLPWKKPSSKFRNPTYNQK

SEQ ID NO: 785 - protein, 19 aa, Canis lupus familiaris
KHLPAAKVPPWPRRSPCLT

SEQ ID NO: 786 - skipped

SEQ ID NO: 787 - protein, 10 aa, Canis lupus familiaris
KHLSQIQKRN

SEQ ID NO: 788 - skipped

SEQ ID NO: 789 - protein, 13 aa, Canis lupus familiaris
KHLTCIFQSRRHL

SEQ ID NO: 790 - protein, 16 aa, Canis lupus familiaris
KHLTLARVKQFIYFKH

SEQ ID NO: 791 - protein, 13 aa, Canis lupus familiaris
KHLVRIQPLFDIS

SEQ ID NO: 792 - protein, 8 aa, Canis lupus familiaris
KHLYNKSK

SEQ ID NO: 793 - protein, 24 aa, Canis lupus familiaris
KHMTWSTLSTAMERRRRFTWKLIL

SEQ ID NO: 794 - protein, 11 aa, Canis lupus familiaris
KHNEKESWSES

SEQ ID NO: 795 - protein, 21 aa, Canis lupus familiaris
KHPRLAGTEPTRRTWSSMAAS

SEQ ID NO: 796 - protein, 8 aa, Canis lupus familiaris
KHPRPKRF

SEQ ID NO: 797 - protein, 23 aa, Canis lupus familiaris
KHQNQAAACENQKRTGRFKASRN

SEQ ID NO: 798 - skipped

SEQ ID NO: 799 - protein, 19 aa, Canis lupus familiaris
KHRSHGRSCYYTPISSGKL

SEQ ID NO: 800 - protein, 8 aa, Canis lupus familiaris
KHSCQIGF

SEQ ID NO: 801 - protein, 33 aa, Canis lupus familiaris
KHSLWKSLISNNHSLMKLRCTVLWPPCIPNESK

SEQ ID NO: 802 - protein, 38 aa, Canis lupus familiaris
KHSYRRIMTPLFLLPRALHFHQYLKVLMIEIPHLCQKQ

SEQ ID NO: 803 - protein, 36 aa, Canis lupus familiaris
KHTCTTRTRSKNRRPKRTTHGTRTTRIIIKTIRRRI

SEQ ID NO: 804 - protein, 17 aa, Canis lupus familiaris
KHTLLCEDLRFGNTPGR

SEQ ID NO: 805 - protein, 19 aa, Canis lupus familiaris
KHTLQKISQVKAIIPLLIT

SEQ ID NO: 806 - protein, 18 aa, Canis lupus familiaris
KHTNPNLPSVQRDGTQPE

SEQ ID NO: 807 - protein, 19 aa, Canis lupus familiaris
KHTSKSLTARRPTDLCHRI

SEQ ID NO: 808 - protein, 42 aa, Canis lupus familiaris
KHVFWRFNETVPKASLLCCCEKLFRMSAEAERQGEQIFPWQQ

SEQ ID NO: 809 - protein, 52 aa, Canis lupus familiaris
KHVLLQEEKIQVLKGIPKISVTPEEMSLHHQEMNLEKRTGEKSEENETRGEL

SEQ ID NO: 810 - protein, 12 aa, Canis lupus familiaris
KHVTELSTSLDC

SEQ ID NO: 811 - protein, 16 aa, Canis lupus familiaris
KHWISSTRSLPQDAVQ

SEQ ID NO: 812 - protein, 13 aa, Canis lupus familiaris
KHYFGRRPHYSSK

SEQ ID NO: 813 - protein, 30 aa, Canis lupus familiaris
KHYLQHQKQRSEGLPHQFHLKKRIIVKKSL

SEQ ID NO: 814 - protein, 15 aa, Canis lupus familiaris
KHYVGRMWYKTFLIF

SEQ ID NO: 815 - protein, 19 aa, Canis lupus familiaris
KIAEDLINLTMGDLIALVT

SEQ ID NO: 816 - protein, 18 aa, Canis lupus familiaris
KIAQLFITMQRYSKWWNE

SEQ ID NO: 817 - protein, 25 aa, Canis lupus familiaris
KIASNIQLQRFRRPSREGRPAKAQL

SEQ ID NO: 818 - protein, 64 aa, Canis lupus familiaris
KIAVDMGFAMIGLIVTVMLDILLQFVSHHHHHQEEVIMMDFGIHKRKATPYSESDMLLLKKMAS

SEQ ID NO: 819 - protein, 10 aa, Canis lupus familiaris
KICLKLFRSS

SEQ ID NO: 820 - protein, 14 aa, Canis lupus familiaris
KICLLVEFCDSVSD

SEQ ID NO: 821 - protein, 25 aa, Canis lupus familiaris
KICLNCWKKCQMGFHLKRLKVISIS

SEQ ID NO: 822 - protein, 86 aa, Canis lupus familiaris
KICQRLQSTKYVSLLCSVILLRDTKVHLNGKEHRITENRKFQMNIAVQEHWTKNCFIPFPRKTARNLHLKGLLFSPMNLRKNLIIC

SEQ ID NO: 823 - protein, 55 aa, Canis lupus familiaris
KICSFCSKCISIYFLTSVFGTVEIFPFELVIYSIFPPSSKTAGEFSERSMVCNFS

SEQ ID NO: 824 - protein, 32 aa, Canis lupus familiaris
KICSILKKLMELRTQKVEIQKLCHASILPFTI

SEQ ID NO: 825 - protein, 15 aa, Canis lupus familiaris
KICTASTQIQMYLSS

SEQ ID NO: 826 - protein, 22 aa, Canis lupus familiaris
KICWILMHRSQFVGTSMDNSLI

SEQ ID NO: 827 - skipped

SEQ ID NO: 828 - protein, 14 aa, Canis lupus familiaris
KIDSLLVTCSKSGK

SEQ ID NO: 829 - protein, 41 aa, Canis lupus familiaris
KIESYWLKDFTSMKKLGINLLSISSYCCQPRTLQTLHYCTS

SEQ ID NO: 830 - protein, 14 aa, Canis lupus familiaris
KIFCSLINQKNHQN

SEQ ID NO: 831 - protein, 10 aa, Canis lupus familiaris
KIFFNPEKCG

SEQ ID NO: 832 - protein, 13 aa, Canis lupus familiaris
KIFIAWLYLPQIG

SEQ ID NO: 833 - protein, 12 aa, Canis lupus familiaris
KIFIFFTTSMLD

SEQ ID NO: 834 - protein, 21 aa, Canis lupus familiaris
KIFIRRLKITQLVIRKQLLKS

SEQ ID NO: 835 - protein, 15 aa, Canis lupus familiaris
KIFLKWLRLWLMARM

SEQ ID NO: 836 - protein, 18 aa, Canis lupus familiaris
KIFQVVLQVFQGKRVLVL

SEQ ID NO: 837 - protein, 42 aa, Canis lupus familiaris
KIFRETIRCPGMRTRLLEKKTNPSGEKIKLFDEKTKPSEWTS

SEQ ID NO: 838 - skipped

SEQ ID NO: 839 - protein, 17 aa, Canis lupus familiaris
KIFRRDFRKFSNRMISL

SEQ ID NO: 840 - protein, 37 aa, Canis lupus familiaris
KIFRRDFRKFSNRMISLSEHYQDQWTTAMDLRSSLLS

SEQ ID NO: 841 - protein, 9 aa, Canis lupus familiaris
KIFTMSMKR

SEQ ID NO: 842 - protein, 11 aa, Canis lupus familiaris
KIGCLKVRKKQ

SEQ ID NO: 843 - protein, 86 aa, Canis lupus familiaris
KIGEPWQMKTTHHNRIAVISVTAMHCRKKSHCLQDSYTTSTKTRKALTMFLTQRQDTSKNTTRLSIWPRQASRLKPLAPNSFLTSH

SEQ ID NO: 844 - protein, 15 aa, Canis lupus familiaris
KIGIPGKKYITLRES

SEQ ID NO: 845 - protein, 50 aa, Canis lupus familiaris
KIGLIMLSGGKRRELGFLKHIGPWISMAFRQMLSFSSPPSTNCFAYSFPT

SEQ ID NO: 846 - protein, 17 aa, Canis lupus familiaris
KIGLLQCGGYCLKRLLM

SEQ ID NO: 847 - protein, 36 aa, Canis lupus familiaris
KIGLLVSRRMEAANAVLGLTMVKKQFCFSPCQCPLI

SEQ ID NO: 848 - protein, 9 aa, Canis lupus familiaris
KIGLRTGLR

SEQ ID NO: 849 - protein, 11 aa, Canis lupus familiaris
KIGWRTRRKIL

SEQ ID NO: 850 - protein, 13 aa, Canis lupus familiaris
KIHWSLVMVCSSR

SEQ ID NO: 851 - protein, 11 aa, Canis lupus familiaris
KIIFLKMKKEL

SEQ ID NO: 852 - protein, 23 aa, Canis lupus familiaris
KIIIRKGVVHQMVKGKRDHIFPT

SEQ ID NO: 853 - protein, 14 aa, Canis lupus familiaris
KIIKYLLVRMTRCV

SEQ ID NO: 854 - protein, 10 aa, Canis lupus familiaris
KIINLKRLAT

SEQ ID NO: 855 - protein, 52 aa, Canis lupus familiaris
KIIQEKNPLNAVTVGKPIAGRLTLQLIRKSIMERDPLCATIVGKRLRIKHNW

SEQ ID NO: 856 - protein, 39 aa, Canis lupus familiaris
KIIRTAPDGMEMKWPKEQRLISKPLSLSSRRQRLPMESS

SEQ ID NO: 857 - protein, 10 aa, Canis lupus familiaris
KIITELWIPL

SEQ ID NO: 858 - protein, 13 aa, Canis lupus familiaris
KIKELEALMPWIS

SEQ ID NO: 859 - protein, 25 aa, Canis lupus familiaris
KIKRKKEMKKKKKPVVSKKNLYLKN

SEQ ID NO: 860 - protein, 45 aa, Canis lupus familiaris
KIKRKKYSNLVIFHLQNFGGYYQALILTSTQCCLHFLLITQRMLL

SEQ ID NO: 861 - protein, 14 aa, Canis lupus familiaris
KIKRRVRDEHLLNC

SEQ ID NO: 862 - protein, 26 aa, Canis lupus familiaris
KIKSCAHGWCRWKTKFCRRQILVLKK

SEQ ID NO: 863 - protein, 11 aa, Canis lupus familiaris
KIKTEFSVITL

SEQ ID NO: 864 - skipped

SEQ ID NO: 865 - protein, 13 aa, Canis lupus familiaris
KILDCMFRRRGMD

SEQ ID NO: 866 - protein, 21 aa, Canis lupus familiaris
KILEQNRKWFLRYTSLKKRKT

SEQ ID NO: 867 - protein, 40 aa, Canis lupus familiaris
KILEQNRKWFLRYTSLKKRSLILHYLRRQKRSTAQLKTCL

SEQ ID NO: 868 - protein, 33 aa, Canis lupus familiaris
KILERSRFCPPLLWTLQTLEWITVISPYSPNTR

SEQ ID NO: 869 - skipped

SEQ ID NO: 870 - protein, 8 aa, Canis lupus familiaris
KILHGKLC

SEQ ID NO: 871-872 - skipped (2 entries)

SEQ ID NO: 873 - protein, 19 aa, Canis lupus familiaris
KILKLTIRSYRRTMLAFSR

SEQ ID NO: 874-875 - skipped (2 entries)

SEQ ID NO: 876 - protein, 26 aa, Canis lupus familiaris
KILLLRGQRCVRVEDMAENLKNISAF

SEQ ID NO: 877 - protein, 12 aa, Canis lupus familiaris
KILLRNFMSWMR

SEQ ID NO: 878 - protein, 20 aa, Canis lupus familiaris
KILMLKHERRSGCKCWIQMT

SEQ ID NO: 879 - protein, 24 aa, Canis lupus familiaris
KILMNFLSTLRVLLIFITFQGTTN

SEQ ID NO: 880 - protein, 21 aa, Canis lupus familiaris
KILMTVESISLRKITPIKQQL

SEQ ID NO: 881 - protein, 49 aa, Canis lupus familiaris
KILPLKDRFQEGVKSPVKWSRFQSLKGSLTPSRLYMMKGLFMSSPQLKN

SEQ ID NO: 882 - protein, 26 aa, Canis lupus familiaris
KILPLKDRFQLYMMKGLFMSSPQLKN

SEQ ID NO: 883 - protein, 16 aa, Canis lupus familiaris
KILQISHPMKDHRLFL

SEQ ID NO: 884 - protein, 53 aa, Canis lupus familiaris
KILRTQRFFIICANSSSYKIKEIIFFHFWGNLSHPSLNLGLRSIITWICFGIF

SEQ ID NO: 885 - protein, 11 aa, Canis lupus familiaris
KILRYSFYIRN

SEQ ID NO: 886 - protein, 8 aa, Canis lupus familiaris
KILSLSKI

SEQ ID NO: 887 - protein, 8 aa, Canis lupus familiaris
KILTKSLW

SEQ ID NO: 888 - protein, 13 aa, Canis lupus familiaris
KILVQQGVKSSQT

SEQ ID NO: 889 - protein, 21 aa, Canis lupus familiaris
KILVVEENHLQAKEFLIGKRL

SEQ ID NO: 890 - protein, 12 aa, Canis lupus familiaris
KIMMLYICLLNP

SEQ ID NO: 891 - protein, 11 aa, Canis lupus familiaris
KIMWTLMNFAW

SEQ ID NO: 892 - protein, 8 aa, Canis lupus familiaris
KINLKIHP

SEQ ID NO: 893 - protein, 27 aa, Canis lupus familiaris
KINRMSRNGSRRGWHILLITLASAGQN

SEQ ID NO: 894 - protein, 10 aa, Canis lupus familiaris
KINTWKRERN

SEQ ID NO: 895 - protein, 10 aa, Canis lupus familiaris
KINWLPGLVD

SEQ ID NO: 896 - protein, 15 aa, Canis lupus familiaris
KIPGFQGSHDGAENL

SEQ ID NO: 897 - skipped

SEQ ID NO: 898 - protein, 22 aa, Canis lupus familiaris
KIPRSCKRLRLSFYIKRRSMIF

SEQ ID NO: 899 - protein, 37 aa, Canis lupus familiaris
KIPSKEWTMRINRKHSLPRCHPSPPLLLPRLITRGCP

SEQ ID NO: 900 - protein, 38 aa, Canis lupus familiaris
KIPSKEWTMRINSRKHSLPRCHPSPPLLLPRLITRGCP

SEQ ID NO: 901 - protein, 18 aa, Canis lupus familiaris
KIPTLLQKKQSFNVARRL

SEQ ID NO: 902 - protein, 47 aa, Canis lupus familiaris
KIQASTTAGFLAVVPACPWERLRVFLLQQRWGFAGIRYLVRGLTGLL

SEQ ID NO: 903 - skipped

SEQ ID NO: 904 - protein, 68 aa, Canis lupus familiaris
KIQFWLNKGYLTVNLRLQMNYQSLILTISLFMLEGPDQSNCLTFHQDQEVQRNQINQMFQICLKVSPA

SEQ ID NO: 905 - protein, 15 aa, Canis lupus familiaris
KIQGLKAVLVQGVLH

SEQ ID NO: 906 - protein, 10 aa, Canis lupus familiaris
KIQIICALTL

SEQ ID NO: 907 - protein, 9 aa, Canis lupus familiaris
KIQIKKENQ

SEQ ID NO: 908 - protein, 15 aa, Canis lupus familiaris
KIQKKVQTVNLLLVT

SEQ ID NO: 909 - protein, 19 aa, Canis lupus familiaris
KIQMCGTLSNSSSVENMLT

SEQ ID NO: 910 - protein, 9 aa, Canis lupus familiaris
KIQMNSTIK

SEQ ID NO: 911 - skipped

SEQ ID NO: 912 - protein, 8 aa, Canis lupus familiaris
KIQVSQTA

SEQ ID NO: 913 - protein, 29 aa, Canis lupus familiaris
KIQVTSGSLQIRFSNLRIQGLRKEKLMMH

SEQ ID NO: 914 - protein, 12 aa, Canis lupus familiaris
KIRDYKNYGLED

SEQ ID NO: 915 - protein, 45 aa, Canis lupus familiaris
KIRESQRIPRRQIMISYVQRRILRIHRTILMPNLRLVQKIVQIWI

SEQ ID NO: 916 - protein, 10 aa, Canis lupus familiaris
KIREWLDHCC

SEQ ID NO: 917 - protein, 46 aa, Canis lupus familiaris
KIRHFLEVEGRLNKEIIHRLDSDAEDIVLPQKEDRICRRDKIIISS

SEQ ID NO: 918 - protein, 9 aa, Canis lupus familiaris
KIRICKRLS

SEQ ID NO: 919 - protein, 33 aa, Canis lupus familiaris
KIRKPREERLGRTLEDQREKKRLETQHFMLLLP

SEQ ID NO: 920 - protein, 14 aa, Canis lupus familiaris
KIRLFFRRSKKKKM

SEQ ID NO: 921 - protein, 11 aa, Canis lupus familiaris
KIRLQMDQNFF

SEQ ID NO: 922 - protein, 42 aa, Canis lupus familiaris
KIRPCGTPFSGLKMNSTGGVMERQCLLMNSLTKRKPTWKLLQ

SEQ ID NO: 923 - skipped

SEQ ID NO: 924 - protein, 59 aa, Canis lupus familiaris
KIRRNRKNPRRKKSPRNPRPRKPLRFPKSQRKRKQKLPRQNPNPAKSQVIRNLIQKQVL

SEQ ID NO: 925 - protein, 29 aa, Canis lupus familiaris
KIRSFILEHSGIKRKRRRFRGTIANLVTW

SEQ ID NO: 926 - protein, 38 aa, Canis lupus familiaris
KIRVILGVEELAQQLPFLSFRKAEQHLFPAQSKVVTRK

SEQ ID NO: 927 - protein, 8 aa, Canis lupus familiaris
KIRWNQET

SEQ ID NO: 928 - protein, 9 aa, Canis lupus familiaris
KISHFLCLN

SEQ ID NO: 929 - protein, 28 aa, Canis lupus familiaris
KISHSSRLTSLISQQNPSHPKRVTPPVF

SEQ ID NO: 930 - protein, 27 aa, Canis lupus familiaris
KISILATDQMRLNQHQKRTRVMSLEAK

SEQ ID NO: 931 - protein, 85 aa, Canis lupus familiaris
KISITPSSAASTPTGRSSQAQLLRSCGSSHLLRPRPTRWMCPYTSWDGTQPSSASREWAMTPMSWGTQPHSTTSPLGMTTPYILG

SEQ ID NO: 932 - protein, 12 aa, Canis lupus familiaris
KISKTNSKFYWP

SEQ ID NO: 933 - protein, 23 aa, Canis lupus familiaris
KISLFIPMGVSLVETAREQLFRG

SEQ ID NO: 934 - protein, 21 aa, Canis lupus familiaris
KISLNTLKMRRWYIASGPLLL

SEQ ID NO: 935 - protein, 22 aa, Canis lupus familiaris
KISLSLLRWCATGSTRTCLPRP

SEQ ID NO: 936 - protein, 38 aa, Canis lupus familiaris
KISQNLQAKKKVVIRLNLKRWIKSPPVAKRSPGMIKKR

SEQ ID NO: 937 - protein, 48 aa, Canis lupus familiaris
KISQVLMWRVGMKMMIPPSKLRRWPKRRQKRKSVKEKREMKKKQNYGS

SEQ ID NO: 938 - protein, 11 aa, Canis lupus familiaris
KISRKPQKRSI

SEQ ID NO: 939 - protein, 9 aa, Canis lupus familiaris
KISRLNDRP

SEQ ID NO: 940 - protein, 8 aa, Canis lupus familiaris
KISSSGCC

SEQ ID NO: 941 - protein, 9 aa, Canis lupus familiaris
KISSSTKIK

SEQ ID NO: 942 - protein, 17 aa, Canis lupus familiaris
KISSVIWPRRQTKTPLQ

SEQ ID NO: 943 - protein, 12 aa, Canis lupus familiaris
KISTDLMLCCFL

SEQ ID NO: 944 - protein, 18 aa, Canis lupus familiaris
KISTIKKLQSWLKNTKQN

SEQ ID NO: 945 - protein, 9 aa, Canis lupus familiaris
KISTSAQQS

SEQ ID NO: 946 - protein, 24 aa, Canis lupus familiaris
KISWRKFKKRKPFSRSWKIWNWVF

SEQ ID NO: 947 - protein, 9 aa, Canis lupus familiaris
KISYKHFSK

SEQ ID NO: 948 - protein, 12 aa, Canis lupus familiaris
KITAAMTVERTS

SEQ ID NO: 949 - protein, 9 aa, Canis lupus familiaris
KITACYLRM

SEQ ID NO: 950 - protein, 19 aa, Canis lupus familiaris
KITCQRLDKSNILYSADSN

SEQ ID NO: 951 - protein, 21 aa, Canis lupus familiaris
KITCVSRLIMVVGVEKEWLDY

SEQ ID NO: 952 - protein, 99 aa, Canis lupus familiaris
KITESGTWTVILTTKLFVSTNQLQTLSVGLNQGHTTSLSNGQELTMLSTMAHSILTSIRVTSSSNTALIWGECSPNEASSMLVFTTCTPIHGVDSLTST

SEQ ID NO: 953 - protein, 8 aa, Canis lupus familiaris
KITPAESR

SEQ ID NO: 954 - protein, 32 aa, Canis lupus familiaris
KITVVFQAPKRNWTRSSRCCGPTSSTAPRPRG

SEQ ID NO: 955 - protein, 20 aa, Canis lupus familiaris
KIVEQERRLRNRKLNLLIPL

SEQ ID NO: 956 - protein, 35 aa, Canis lupus familiaris
KIVKINVELPWWKIFLKALTIQKMHHFTYHFSKAG

SEQ ID NO: 957 - protein, 18 aa, Canis lupus familiaris
KIVLHHGHFLLQVWQLTE

SEQ ID NO: 958 - protein, 33 aa, Canis lupus familiaris
KIVNFKKSMNCSRKPGDKVCLLHSGMGRPLLFG

SEQ ID NO: 959 - protein, 43 aa, Canis lupus familiaris
KIVRRSRTVKLVRILNQKKRKLRRTRNSLILVKKEKAISGRRK

SEQ ID NO: 960 - protein, 42 aa, Canis lupus familiaris
KIVRRSRTVKLVRILNQKRKLRRTRNSLILVKKEKAISGRRK

SEQ ID NO: 961 - protein, 34 aa, Canis lupus familiaris
KIVSGAGGMKNWVAWRLHCAGRPLSYWMTGCFSG

SEQ ID NO: 962 - protein, 13 aa, Canis lupus familiaris
KIVYIPVQQFRQY

SEQ ID NO: 963 - protein, 39 aa, Canis lupus familiaris
KIWKTRHPKQKVSVMAKRDRRPVRTKLKAPRKSTCTAPG

SEQ ID NO: 964 - protein, 16 aa, Canis lupus familiaris
KIWLILMVKNLGVKRN

SEQ ID NO: 965 - protein, 63 aa, Canis lupus familiaris
KIWNVISMRRPLVMVYTTLNIRKLILERNLMKIGKGISGTHNLPPNIIRVFMVGRNIMCMKEP

SEQ ID NO: 966 - protein, 18 aa, Canis lupus familiaris
KIWPFLIHQMLTIYTVQR

SEQ ID NO: 967 - protein, 10 aa, Canis lupus familiaris
KIYENNFMEH

SEQ ID NO: 968 - protein, 24 aa, Canis lupus familiaris
KIYFFHIIALWPAREAQTPSTLSC

SEQ ID NO: 969 - protein, 38 aa, Canis lupus familiaris
KIYHHKITSYRKRKPKFLSQYLILEASRLNAIFLIRRT

SEQ ID NO: 970 - protein, 12 aa, Canis lupus familiaris
KIYLGLLKSNRK

SEQ ID NO: 971 - protein, 12 aa, Canis lupus familiaris
KIYLIFPTTCLR

SEQ ID NO: 972 - protein, 8 aa, Canis lupus familiaris
KIYLKLMI

SEQ ID NO: 973 - protein, 11 aa, Canis lupus familiaris
KIYMLEKTHLH

SEQ ID NO: 974 - protein, 34 aa, Canis lupus familiaris
KIYTVKFLVLTVIEWFGVMIPHCVQRYCVSHLEK

SEQ ID NO: 975 - protein, 15 aa, Canis lupus familiaris
KIYYPKSLLSSPGLL

SEQ ID NO: 976 - protein, 11 aa, Canis lupus familiaris
KKAENFYSKTS

SEQ ID NO: 977 - protein, 14 aa, Canis lupus familiaris
KKCPPRRKFRRFRC

SEQ ID NO: 978 - protein, 38 aa, Canis lupus familiaris
KKECRNHVAGCNDLSQTKRYSFHLLQKCQRQDVDVSDS

SEQ ID NO: 979 - protein, 8 aa, Canis lupus familiaris
KKERFKEC

SEQ ID NO: 980 - protein, 11 aa, Canis lupus familiaris
KKESSSLLFKR

SEQ ID NO: 981 - protein, 13 aa, Canis lupus familiaris
KKFHSVQSRSGWQ

SEQ ID NO: 982 - protein, 14 aa, Canis lupus familiaris
KKGCKLSNKASSYR

SEQ ID NO: 983 - protein, 13 aa, Canis lupus familiaris
KKGEDSQDEKGQI

SEQ ID NO: 984 - protein, 10 aa, Canis lupus familiaris
KKGGGAGRNE

SEQ ID NO: 985 - protein, 9 aa, Canis lupus familiaris
KKGGGGRNE

SEQ ID NO: 986 - protein, 8 aa, Canis lupus familiaris
KKGLPNNL

SEQ ID NO: 987 - protein, 9 aa, Canis lupus familiaris
KKGQLTIRC

SEQ ID NO: 988 - skipped

SEQ ID NO: 989 - protein, 27 aa, Canis lupus familiaris
KKGSEHSGQEEKTRWLLIRRRGRGGCQ

SEQ ID NO: 990 - protein, 11 aa, Canis lupus familiaris
KKHYFKVHWKS

SEQ ID NO: 991 - protein, 12 aa, Canis lupus familiaris
KKISLKKRTCGG

SEQ ID NO: 992 - protein, 8 aa, Canis lupus familiaris
KKKAWLVQ

SEQ ID NO: 993 - protein, 15 aa, Canis lupus familiaris
KKKCLPPKEGSLSVV

SEQ ID NO: 994 - protein, 29 aa, Canis lupus familiaris
KKKEDITPFSLLRFLWNKQDCRWIQWNFF

SEQ ID NO: 995 - protein, 11 aa, Canis lupus familiaris
KKKGERNSAGR

SEQ ID NO: 996 - protein, 17 aa, Canis lupus familiaris
KKKILQIGILRSSQSQK

SEQ ID NO: 997-998 - skipped (2 entries)

SEQ ID NO: 999 - protein, 18 aa, Canis lupus familiaris
KKKLWGKRSKSWRHEPEN

SEQ ID NO: 1000 - protein, 22 aa, Canis lupus familiaris
KKKRKERPKVEKKKIKRAGKKI

SEQ ID NO: 1001 - skipped

SEQ ID NO: 1002 - protein, 14 aa, Canis lupus familiaris
KKLKHSSLSLKPLR

SEQ ID NO: 1003 - protein, 24 aa, Canis lupus familiaris
KKLRDFLVQEGQRGEKQELRRIKQ

SEQ ID NO: 1004 - protein, 8 aa, Canis lupus familiaris
KKLVKEMK

SEQ ID NO: 1005 - protein, 16 aa, Canis lupus familiaris
KKMIITGSKCRSLQIF

SEQ ID NO: 1006 - protein, 12 aa, Canis lupus familiaris
KKMPAKKKQYLK

SEQ ID NO: 1007 - protein, 22 aa, Canis lupus familiaris
KKMRVRMELKLLHPPGMRLRCR

SEQ ID NO: 1008 - protein, 14 aa, Canis lupus familiaris
KKNFNRLSVSEEKG

SEQ ID NO: 1009 - protein, 10 aa, Canis lupus familiaris
KKNGQGLHKN

SEQ ID NO: 1010 - protein, 9 aa, Canis lupus familiaris
KKNGRKHFC

SEQ ID NO: 1011 - protein, 32 aa, Canis lupus familiaris
KKNKSGFQSRRRIYSISKQRKRLIFFDDKGNT

SEQ ID NO: 1012 - protein, 11 aa, Canis lupus familiaris
KKNLLELHTTD

SEQ ID NO: 1013 - skipped

SEQ ID NO: 1014 - protein, 21 aa, Canis lupus familiaris
KKNRKRGFDSFFSRSSIPHGQ

SEQ ID NO: 1015 - protein, 46 aa, Canis lupus familiaris
KKPRKRVILNNLSKLARLDLEGENIRVYNIAIILSDLSAVHLRACT

SEQ ID NO: 1016 - protein, 19 aa, Canis lupus familiaris
KKPVVHRRNHKTRVLKQDQ

SEQ ID NO: 1017 - protein, 29 aa, Canis lupus familiaris
KKQENLGQLDDNPRTDDPRGQVSGWHTSS

SEQ ID NO: 1018 - protein, 12 aa, Canis lupus familiaris
KKQIVFMESGFL

SEQ ID NO: 1019 - protein, 46 aa, Canis lupus familiaris
KKQRLPWRRGMRMLNVTSGMQCFVVSWLSMRASRGASRVALASRSI

SEQ ID NO: 1020 - protein, 19 aa, Canis lupus familiaris
KKQRNIEIRRKEDAFQKQR

SEQ ID NO: 1021 - protein, 8 aa, Canis lupus familiaris
KKREARSK

SEQ ID NO: 1022 - protein, 10 aa, Canis lupus familiaris
KKRFLGPNLI

SEQ ID NO: 1023 - protein, 11 aa, Canis lupus familiaris
KKRGGRQETAV

SEQ ID NO: 1024 - protein, 26 aa, Canis lupus familiaris
KKRIFQKKKIHRIRILLWIVKEQPTK

SEQ ID NO: 1025 - skipped

SEQ ID NO: 1026 - protein, 28 aa, Canis lupus familiaris
KKRRKANQQKKPILGIQRRKQSKHLKNY

SEQ ID NO: 1027 - protein, 16 aa, Canis lupus familiaris
KKRSKQSSYEREIGKP

SEQ ID NO: 1028 - protein, 20 aa, Canis lupus familiaris
KKSELSNIHRESESAPETTG

SEQ ID NO: 1029 - protein, 11 aa, Canis lupus familiaris
KKSFLIKTHSV

SEQ ID NO: 1030 - protein, 8 aa, Canis lupus familiaris
KKSTEGGS

SEQ ID NO: 1031 - protein, 60 aa, Canis lupus familiaris
KKSTYKELFLNTVVQTAQLKELIVLIGWKKKLFCRFYVWVIYTTLMYDIPSISPWKRRTT

SEQ ID NO: 1032 - protein, 17 aa, Canis lupus familiaris
KKSYSHHNVKWKSTHGK

SEQ ID NO: 1033 - protein, 25 aa, Canis lupus familiaris
KKTFYSARTSFWKEEGSNDDRSSRT

SEQ ID NO: 1034 - protein, 50 aa, Canis lupus familiaris
KKTGTNPSSTREHRKRPSGEHFSLSSFTDLFSRSRISSFMCYLLEKQAYL

SEQ ID NO: 1035 - protein, 16 aa, Canis lupus familiaris
KKTRFLPTGGWGCYRR

SEQ ID NO: 1036 - protein, 13 aa, Canis lupus familiaris
KKTRNGRKKKKKR

SEQ ID NO: 1037 - protein, 22 aa, Canis lupus familiaris
KKVPGQPALEKAHQTRNRKREA

SEQ ID NO: 1038 - protein, 20 aa, Canis lupus familiaris
KKVSQCLLQTLRNPWGPMMP

SEQ ID NO: 1039-1040 - skipped (2 entries)

SEQ ID NO: 1041 - protein, 13 aa, Canis lupus familiaris
KLAPCTVSKEAVN

SEQ ID NO: 1042 - protein, 38 aa, Canis lupus familiaris
KLASSSTLTLDIFLEISSLNLALKGNGCLLFLPMISFM

SEQ ID NO: 1043 - protein, 9 aa, Canis lupus familiaris
KLAWEQKFQ

SEQ ID NO: 1044 - protein, 16 aa, Canis lupus familiaris
KLCCCFRNFYRRTEIR

SEQ ID NO: 1045 - protein, 15 aa, Canis lupus familiaris
KLCCIMGIFYCKCGS

SEQ ID NO: 1046 - protein, 32 aa, Canis lupus familiaris
KLCGGYGDKTQSSDNTSTSYNPAVESCHHYYS

SEQ ID NO: 1047 - protein, 56 aa, Canis lupus familiaris
KLCPQLRAAAAPESPCGWENSEESGAGEELFCPPGAPQEPPGGQALQLLRLWGLLS

SEQ ID NO: 1048 - protein, 16 aa, Canis lupus familiaris
KLCRPRFQWRLYSLWK

SEQ ID NO: 1049 - protein, 28 aa, Canis lupus familiaris
KLDNLRNSLKGKEIASPPTVILQPIQRY

SEQ ID NO: 1050 - protein, 8 aa, Canis lupus familiaris
KLEAYFYP

SEQ ID NO: 1051 - protein, 11 aa, Canis lupus familiaris
KLEKNRIFYNY

SEQ ID NO: 1052 - protein, 18 aa, Canis lupus familiaris
KLERQKESMKNHLLKSDS

SEQ ID NO: 1053 - protein, 43 aa, Canis lupus familiaris
KLETQKCLKGMTKVSTPPTKSPSLLCLGGQGLMPRKSVVFTML

SEQ ID NO: 1054 - protein, 58 aa, Canis lupus familiaris
KLETSWSQPAEMLSKQEKLLASQLEELFPVQRQLCLHGFLLSPVPAPRVSLSHLTGSL

SEQ ID NO: 1055 - protein, 17 aa, Canis lupus familiaris
KLEVQKMYLIQKNPLKN

SEQ ID NO: 1056 - protein, 13 aa, Canis lupus familiaris
KLFHSAFQEISQI

SEQ ID NO: 1057 - skipped

SEQ ID NO: 1058 - protein, 21 aa, Canis lupus familiaris
KLFPKFCGSKTQESLFRKETF

SEQ ID NO: 1059 - protein, 17 aa, Canis lupus familiaris
KLFQQTHSVRFVLATMS

SEQ ID NO: 1060 - protein, 57 aa, Canis lupus familiaris
KLFTRQLIYVRCLSPQLMVISILLWRNQLLLLIPKQARKRIRTKRRSLYGTMELLCL

SEQ ID NO: 1061 - protein, 10 aa, Canis lupus familiaris
KLFVIYRKVK

SEQ ID NO: 1062 - protein, 9 aa, Canis lupus familiaris
KLGKEVPNV

SEQ ID NO: 1063 - protein, 11 aa, Canis lupus familiaris
KLGKNRRNLYL

SEQ ID NO: 1064 - protein, 8 aa, Canis lupus familiaris
KLGKQKRN

SEQ ID NO: 1065 - protein, 12 aa, Canis lupus familiaris
KLGLNMKRNSKP

SEQ ID NO: 1066 - protein, 8 aa, Canis lupus familiaris
KLGVDLLL

SEQ ID NO: 1067 - protein, 14 aa, Canis lupus familiaris
KLHELLRRNPSWRK

SEQ ID NO: 1068 - protein, 43 aa, Canis lupus familiaris
KLHGIVCPCHAQDPGKPGKKRGTLCHGVLQSLENPANKWRTLV

SEQ ID NO: 1069 - protein, 8 aa, Canis lupus familiaris
KLHLSYTN

SEQ ID NO: 1070 - protein, 9 aa, Canis lupus familiaris
KLHMYCSIT

SEQ ID NO: 1071 - protein, 11 aa, Canis lupus familiaris
KLHRRCYSKRQ

SEQ ID NO: 1072 - protein, 12 aa, Canis lupus familiaris
KLIGEFTHLCNL

SEQ ID NO: 1073 - protein, 11 aa, Canis lupus familiaris
KLIGHGKPACK

SEQ ID NO: 1074 - protein, 19 aa, Canis lupus familiaris
KLIIQRFSGTQHQTLSSGD

SEQ ID NO: 1075 - protein, 8 aa, Canis lupus familiaris
KLILLFLN

SEQ ID NO: 1076 - protein, 36 aa, Canis lupus familiaris
KLINPGTIKMAINSGNINWKDSTGSYSIGTIDETAF

SEQ ID NO: 1077 - protein, 46 aa, Canis lupus familiaris
KLIQGKNLMDAVNVEKPSRDLSSLDTRELTLERNHIIAVNVGKALV

SEQ ID NO: 1078 - protein, 13 aa, Canis lupus familiaris
KLIQLLLLCCIKS

SEQ ID NO: 1079 - protein, 8 aa, Canis lupus familiaris
KLIVIKKI

SEQ ID NO: 1080 - protein, 9 aa, Canis lupus familiaris
KLKDGDLLW

SEQ ID NO: 1081-1082 - skipped (2 entries)

SEQ ID NO: 1083 - protein, 9 aa, Canis lupus familiaris
KLKGFYLKV

SEQ ID NO: 1084 - protein, 55 aa, Canis lupus familiaris
KLKGLIQFRNQVITLDWAPCLPSSAHVPTNRLSAGLKKPSKKAKRPFLSSIPLLI

SEQ ID NO: 1085 - protein, 13 aa, Canis lupus familiaris
KLKKEAVVRSFKS

SEQ ID NO: 1086 - protein, 9 aa, Canis lupus familiaris
KLKKRLPRT

SEQ ID NO: 1087 - protein, 23 aa, Canis lupus familiaris
KLKKSANCCVVLFLKHLSIMMNM

SEQ ID NO: 1088 - protein, 13 aa, Canis lupus familiaris
KLKKTSSLQTHQS

SEQ ID NO: 1089 - protein, 19 aa, Canis lupus familiaris
KLKLLLEYLVNIQIMKQKV

SEQ ID NO: 1090 - protein, 11 aa, Canis lupus familiaris
KLKLSSFYLIC

SEQ ID NO: 1091 - protein, 31 aa, Canis lupus familiaris
KLKNLFVWVNLRKRSPLVRLVFFFKFLSHVL

SEQ ID NO: 1092 - protein, 15 aa, Canis lupus familiaris
KLKQKPLCSCLLPRM

SEQ ID NO: 1093 - protein, 11 aa, Canis lupus familiaris
KLKRILIQQLW

SEQ ID NO: 1094 - protein, 9 aa, Canis lupus familiaris
KLKRNSQYP

SEQ ID NO: 1095 - protein, 17 aa, Canis lupus familiaris
KLKRTGKRLWPVELRNY

SEQ ID NO: 1096 - protein, 17 aa, Canis lupus familiaris
KLKWMRRTNPGQSNRQN

SEQ ID NO: 1097 - protein, 9 aa, Canis lupus familiaris
KLLCEKSSY

SEQ ID NO: 1098 - protein, 21 aa, Canis lupus familiaris
KLLDLHLALRFGRVLTLGPNS

SEQ ID NO: 1099 - protein, 26 aa, Canis lupus familiaris
KLLFLLHNDPRNGEAPSSCAGIKLVC

SEQ ID NO: 1100 - protein, 12 aa, Canis lupus familiaris
KLLFLPARKFSL

SEQ ID NO: 1101 - protein, 8 aa, Canis lupus familiaris
KLLFMILV

SEQ ID NO: 1102 - protein, 45 aa, Canis lupus familiaris
KLLGHPGFTTSACSESWIHLVPSQNLTMLTMPSLKATRRPGANGI

SEQ ID NO: 1103 - protein, 13 aa, Canis lupus familiaris
KLLKLTWVIKGHS

SEQ ID NO: 1104 - protein, 9 aa, Canis lupus familiaris
KLLKPLTGA

SEQ ID NO: 1105 - protein, 62 aa, Canis lupus familiaris
KLLLDVASTASFDSRCCRTRRGSKTCHQVTPRQRSGHRSEEAVGPGQLQKALWASSPKGCGS

SEQ ID NO: 1106 - protein, 22 aa, Canis lupus familiaris
KLLLLPKSRHQEWSGCGGLVWL

SEQ ID NO: 1107 - protein, 8 aa, Canis lupus familiaris
KLLLVFGK

SEQ ID NO: 1108 - protein, 58 aa, Canis lupus familiaris
KLLLWLVLLFRGLLFHHRRNCGSRCRAHLYRKTSAVTCQIPLGAPEEIYLCSPSTLQV

SEQ ID NO: 1109 - protein, 26 aa, Canis lupus familiaris
KLLMLKLKYWTFIILINFLKVWMGLT

SEQ ID NO: 1110 - protein, 40 aa, Canis lupus familiaris
KLLPTFSYKGSEDRQGRVDRQRHSSEDWLRCRPRRVPRLA

SEQ ID NO: 1111 - protein, 12 aa, Canis lupus familiaris
KLLQQLGKKKSS

SEQ ID NO: 1112 - protein, 8 aa, Canis lupus familiaris
KLLQQSMN

SEQ ID NO: 1113 - protein, 15 aa, Canis lupus familiaris
KLLVLMNTAIGLKRS

SEQ ID NO: 1114-1115 - skipped (2 entries)

SEQ ID NO: 1116 - protein, 14 aa, Canis lupus familiaris
KLMKLLNRNPNIKK

SEQ ID NO: 1117 - protein, 8 aa, Canis lupus familiaris
KLMKNLII

SEQ ID NO: 1118 - protein, 9 aa, Canis lupus familiaris
KLMLRWSRE

SEQ ID NO: 1119 - protein, 15 aa, Canis lupus familiaris
KLMNILTSGLSLLPG

SEQ ID NO: 1120 - protein, 17 aa, Canis lupus familiaris
KLMQLFLTHFSIRPTSL

SEQ ID NO: 1121 - protein, 8 aa, Canis lupus familiaris
KLMRNLII

SEQ ID NO: 1122 - protein, 36 aa, Canis lupus familiaris
KLMTQVHSLNWSTGNACQPNSITSSNRLKGQLVRLS

SEQ ID NO: 1123 - protein, 11 aa, Canis lupus familiaris
KLNIKKKNLQL

SEQ ID NO: 1124 - protein, 12 aa, Canis lupus familiaris
KLNKFSNCLKKY

SEQ ID NO: 1125 - protein, 9 aa, Canis lupus familiaris
KLNLMILKS

SEQ ID NO: 1126 - protein, 13 aa, Canis lupus familiaris
KLNPNHLCQSEAF

SEQ ID NO: 1127 - protein, 23 aa, Canis lupus familiaris
KLNRRVKVPLMRSVPLNSYSLRS

SEQ ID NO: 1128 - protein, 8 aa, Canis lupus familiaris
KLNWKTQI

SEQ ID NO: 1129 - protein, 14 aa, Canis lupus familiaris
KLPAEKQTDSGHAL

SEQ ID NO: 1130 - protein, 8 aa, Canis lupus familiaris
KLPCRLQK

SEQ ID NO: 1131 - protein, 40 aa, Canis lupus familiaris
KLPGYIKVLSWYWSQKDLNCPVNVYTMCCGTQDVSKSLRC

SEQ ID NO: 1132 - protein, 8 aa, Canis lupus familiaris
KLPLKIVK

SEQ ID NO: 1133 - protein, 13 aa, Canis lupus familiaris
KLPQNMCFTASLL

SEQ ID NO: 1134 - protein, 19 aa, Canis lupus familiaris
KLPRKSKTIKTLHLCLVLV

SEQ ID NO: 1135 - protein, 66 aa, Canis lupus familiaris
KLPRLLVSRPPSLHPSQQAETRPERLLVPLIQKKQLGPNHQLHHLLPPPHLVPELRRRHSLAKQGQ

SEQ ID NO: 1136 - protein, 47 aa, Canis lupus familiaris
KLPSLKTMNLSVSLSTVGRHMQVTTIPSLRTGGAVEKESGTSLMTQS

SEQ ID NO: 1137 - protein, 19 aa, Canis lupus familiaris
KLPTPPNSGPKSAKYPSQP

SEQ ID NO: 1138 - protein, 37 aa, Canis lupus familiaris
KLQAKPRNFRSRSTALRKPSSLLCKRSCRSIWQRRRS

SEQ ID NO: 1139 - skipped

SEQ ID NO: 1140 - protein, 24 aa, Canis lupus familiaris
KLQETMDQVIILHFRVHLPQSSGI

SEQ ID NO: 1141 - protein, 70 aa, Canis lupus familiaris
KLQEVNISAAMNVWTVLKITTVTRQIWITASYATMKLTGPLSGAQGALKRKWNISTGMIPWLYCSWPSPY

SEQ ID NO: 1142 - protein, 13 aa, Canis lupus familiaris
KLQGSLSSTTHTS

SEQ ID NO: 1143 - protein, 51 aa, Canis lupus familiaris
KLQHGKEIWCILLLWFSSLLRHPSRSSWWLVIFFACWLMKQPCQREQGVLE

SEQ ID NO: 1144 - skipped

SEQ ID NO: 1145 - protein, 17 aa, Canis lupus familiaris
KLQMKNSNKPVCSSATV

SEQ ID NO: 1146 - protein, 40 aa, Canis lupus familiaris
KLQMRMPCGAFGRRRSRSNICSASWVLPSRKRKLCCQRWM

SEQ ID NO: 1147 - protein, 9 aa, Canis lupus familiaris
KLQNPLFAP

SEQ ID NO: 1148 - skipped

SEQ ID NO: 1149 - protein, 9 aa, Canis lupus familiaris
KLQRETMDN

SEQ ID NO: 1150 - protein, 10 aa, Canis lupus familiaris
KLQRIIVPRR

SEQ ID NO: 1151 - protein, 14 aa, Canis lupus familiaris
KLQRPQMRSSLIFY

SEQ ID NO: 1152 - protein, 26 aa, Canis lupus familiaris
KLQRRKMIYKEQPKDMKKSLMLVKKK

SEQ ID NO: 1153 - protein, 12 aa, Canis lupus familiaris
KLQRYLVLELTM

SEQ ID NO: 1154 - protein, 38 aa, Canis lupus familiaris
KLQSGPSQYGVLCFTLLLLYLWLRIYQQRKSPGSYERA

SEQ ID NO: 1155 - protein, 29 aa, Canis lupus familiaris
KLQTDNPGSRTVCKKLRNISGMFKTSCHG

SEQ ID NO: 1156 - protein, 10 aa, Canis lupus familiaris
KLQTTEDYFC

SEQ ID NO: 1157 - protein, 10 aa, Canis lupus familiaris
KLQVLVQFAV

SEQ ID NO: 1158 - protein, 9 aa, Canis lupus familiaris
KLQWTWDLQ

SEQ ID NO: 1159 - protein, 10 aa, Canis lupus familiaris
KLRDSEKAYC

SEQ ID NO: 1160 - protein, 14 aa, Canis lupus familiaris
KLRGSLVQEIGTDQ

SEQ ID NO: 1161 - protein, 8 aa, Canis lupus familiaris
KLRKFQYM

SEQ ID NO: 1162 - protein, 23 aa, Canis lupus familiaris
KLRQVLGCGPPHIWGLRCGIKGS

SEQ ID NO: 1163 - protein, 14 aa, Canis lupus familiaris
KLRRRTQFSSGCPL

SEQ ID NO: 1164 - protein, 21 aa, Canis lupus familiaris
KLRRSGTRFYQFGDPKKPAML

SEQ ID NO: 1165 - protein, 36 aa, Canis lupus familiaris
KLRSLFLSRYPSVYPVLIFRLQKGHCTSGIMSIFLV

SEQ ID NO: 1166 - protein, 10 aa, Canis lupus familiaris
KLRSLKITQV

SEQ ID NO: 1167 - protein, 17 aa, Canis lupus familiaris
KLRTFFPKRSSNLNQME

SEQ ID NO: 1168 - skipped

SEQ ID NO: 1169 - protein, 10 aa, Canis lupus familiaris
KLSIACLGLE

SEQ ID NO: 1170 - protein, 9 aa, Canis lupus familiaris
KLSISTQLK

SEQ ID NO: 1171 - protein, 13 aa, Canis lupus familiaris
KLSKRRHQILKQI

SEQ ID NO: 1172 - protein, 17 aa, Canis lupus familiaris
KLSKTLTLKSQFLHCRN

SEQ ID NO: 1173 - protein, 13 aa, Canis lupus familiaris
KLSLLRARSSPYS

SEQ ID NO: 1174 - protein, 9 aa, Canis lupus familiaris
KLSLRSERP

SEQ ID NO: 1175 - protein, 69 aa, Canis lupus familiaris
KLSLTPQSQDCLHSQMSAQQLGNRQKEPKRQDSCKHLLIPEKDILKSKYWKVTGRWHFPYPTRKMQGSR

SEQ ID NO: 1176 - protein, 49 aa, Canis lupus familiaris
KLSPPVLHTCLLFPLHTAAVFSSISSLRPKKRWISIKGYPCSLHLLLLC

SEQ ID NO: 1177 - protein, 24 aa, Canis lupus familiaris
KLSQCWRQRCWTTRRAAWPPSLNP

SEQ ID NO: 1178 - protein, 28 aa, Canis lupus familiaris
KLSRQCLGLGLRGHEVSGGPTSKTWQSN

SEQ ID NO: 1179-1180 - skipped (2 entries)

SEQ ID NO: 1181 - protein, 8 aa, Canis lupus familiaris
KLSTIWNS

SEQ ID NO: 1182 - protein, 11 aa, Canis lupus familiaris
KLSVQPQMGWK

SEQ ID NO: 1183 - protein, 8 aa, Canis lupus familiaris
KLSVSWER

SEQ ID NO: 1184 - protein, 25 aa, Canis lupus familiaris
KLTGKTTQKLYGGPCREKRDGIGYK

SEQ ID NO: 1185 - protein, 25 aa, Canis lupus familiaris
KLTMNYTDYKHFSSICSVITEIRIS

SEQ ID NO: 1186 - protein, 9 aa, Canis lupus familiaris
KLTPSINSL

SEQ ID NO: 1187 - protein, 19 aa, Canis lupus familiaris
KLTQKEMFLLPCQEAVLCV

SEQ ID NO: 1188 - skipped

SEQ ID NO: 1189 - protein, 20 aa, Canis lupus familiaris
KLTTTTESTQVPNVEMKGMN

SEQ ID NO: 1190 - protein, 34 aa, Canis lupus familiaris
KLVCWSQEEWKLQTRSSDSLWSKSNFVSPPASVL

SEQ ID NO: 1191 - protein, 11 aa, Canis lupus familiaris
KLVFSVLVPKG

SEQ ID NO: 1192 - protein, 45 aa, Canis lupus familiaris
KLVGSVDSGRDYSDHCWKHTRHHGSVPREKAAERHQLFPDVTCHS

SEQ ID NO: 1193 - protein, 9 aa, Canis lupus familiaris
KLVLSSWLP

SEQ ID NO: 1194 - protein, 45 aa, Canis lupus familiaris
KLVNTLSKARGPAHLEANAFTATLTLTGGWQSLRSPGSSSVLRAP

SEQ ID NO: 1195 - protein, 24 aa, Canis lupus familiaris
KLVRRCFPTEESQLLSLIVKGYRS

SEQ ID NO: 1196 - protein, 43 aa, Canis lupus familiaris
KLVSNKGQIVKILKELCLLGENDHMLSCLLPHHLTTLKPKTVT

SEQ ID NO: 1197 - protein, 11 aa, Canis lupus familiaris
KLVSPAKNTLR

SEQ ID NO: 1198 - protein, 31 aa, Canis lupus familiaris
KLWGGSVGSWVLHWATPQKQGNSCLKGTRCS

SEQ ID NO: 1199 - protein, 9 aa, Canis lupus familiaris
KLWIQRFQY

SEQ ID NO: 1200 - protein, 24 aa, Canis lupus familiaris
KLWNLVLAKSQFIKTQIARKRRHL

SEQ ID NO: 1201 - protein, 9 aa, Canis lupus familiaris
KLWPPALPI

SEQ ID NO: 1202 - skipped

SEQ ID NO: 1203 - protein, 18 aa, Canis lupus familiaris
KLWTSEGDGGAGPAPGGQ

SEQ ID NO: 1204 - protein, 8 aa, Canis lupus familiaris
KLYGIKHN

SEQ ID NO: 1205 - protein, 12 aa, Canis lupus familiaris
KMAFVRKHIVGT

SEQ ID NO: 1206 - protein, 8 aa, Canis lupus familiaris
KMAKHKLF

SEQ ID NO: 1207 - protein, 15 aa, Canis lupus familiaris
KMCHLCQHQNWLQHQ

SEQ ID NO: 1208 - protein, 14 aa, Canis lupus familiaris
KMDGGCMEEMVLKT

SEQ ID NO: 1209 - skipped

SEQ ID NO: 1210 - protein, 12 aa, Canis lupus familiaris
KMDVIQIHLKAH

SEQ ID NO: 1211 - protein, 28 aa, Canis lupus familiaris
KMEFLFVLSKAFFPRYLASSLGQTLFSG

SEQ ID NO: 1212 - protein, 13 aa, Canis lupus familiaris
KMEGFMLSTRDQP

SEQ ID NO: 1213 - protein, 13 aa, Canis lupus familiaris
KMEKNTSCSTLTF

SEQ ID NO: 1214 - protein, 31 aa, Canis lupus familiaris
KMEMALRNQYVLALVGVTLHCLENYLYLYLA

SEQ ID NO: 1215 - protein, 25 aa, Canis lupus familiaris
KMEYSKLKLSSPFWTWLQEPVMLPQ

SEQ ID NO: 1216 - protein, 16 aa, Canis lupus familiaris
KMFIWKTKTVNLVIVK

SEQ ID NO: 1217 - protein, 36 aa, Canis lupus familiaris
KMFQRSGPLWLALLLHSVVTTGVIGDIMWAKSISGL

SEQ ID NO: 1218 - skipped

SEQ ID NO: 1219 - protein, 16 aa, Canis lupus familiaris
KMHIIPTSLNAPKDPV

SEQ ID NO: 1220 - protein, 27 aa, Canis lupus familiaris
KMIGHLHLLFLYKKILFITGRQLPITT

SEQ ID NO: 1221 - protein, 8 aa, Canis lupus familiaris
KMILKPHI

SEQ ID NO: 1222 - protein, 15 aa, Canis lupus familiaris
KMISCRKKERLLICY

SEQ ID NO: 1223 - protein, 34 aa, Canis lupus familiaris
KMITLWKVLVTESYLRRSFQKWTTVVIMPAMQIP

SEQ ID NO: 1224 - protein, 37 aa, Canis lupus familiaris
KMKKGMKNLQSPMGQGSQMHFPSSKQKIVITCFLHWT

SEQ ID NO: 1225 - protein, 27 aa, Canis lupus familiaris
KMKKITLSVVYQGTEQLCSRHCHSLES

SEQ ID NO: 1226 - protein, 20 aa, Canis lupus familiaris
KMKKTPNLQTMRTIRRTGSC

SEQ ID NO: 1227 - protein, 8 aa, Canis lupus familiaris
KMKMTGRV

SEQ ID NO: 1228 - protein, 11 aa, Canis lupus familiaris
KMKNSQKNWRK

SEQ ID NO: 1229 - protein, 21 aa, Canis lupus familiaris
KMKQNSSQRHLLLPPPSASMG

SEQ ID NO: 1230 - skipped

SEQ ID NO: 1231 - protein, 18 aa, Canis lupus familiaris
KMKTYKLGSERSQNKSCL

SEQ ID NO: 1232 - skipped

SEQ ID NO: 1233 - protein, 25 aa, Canis lupus familiaris
KMKVGSGFPGKNFLPWTSFSGYCDV

SEQ ID NO: 1234 - skipped

SEQ ID NO: 1235 - protein, 10 aa, Canis lupus familiaris
KMLDRFLEDF

SEQ ID NO: 1236 - skipped

SEQ ID NO: 1237 - protein, 13 aa, Canis lupus familiaris
KMLKNYWKKYLYH

SEQ ID NO: 1238 - protein, 17 aa, Canis lupus familiaris
KMLLGKQPELLGLMFCG

SEQ ID NO: 1239 - protein, 26 aa, Canis lupus familiaris
KMLLLGNQIHSILLGKIIYYVCAMIS

SEQ ID NO: 1240 - skipped

SEQ ID NO: 1241 - protein, 13 aa, Canis lupus familiaris
KMLPRFYTYLAWM

SEQ ID NO: 1242 - protein, 31 aa, Canis lupus familiaris
KMLPWGLNHKRTNQAQSNNSQSSSLPHLLTL

SEQ ID NO: 1243 - protein, 8 aa, Canis lupus familiaris
KMLQIVLC

SEQ ID NO: 1244 - protein, 61 aa, Canis lupus familiaris
KMLQTLVLRSLQIARSCRKRRRRRRRVHVLLPLLRRPWIARAPHQFVHQHFWRNENLKQLK

SEQ ID NO: 1245 - protein, 10 aa, Canis lupus familiaris
KMMDYSIDQM

SEQ ID NO: 1246 - protein, 12 aa, Canis lupus familiaris
KMMRQSLQKHLS

SEQ ID NO: 1247 - protein, 33 aa, Canis lupus familiaris
KMMRTKRLNKMASNQKIKLIRPRPKFRLASVDT

SEQ ID NO: 1248 - protein, 44 aa, Canis lupus familiaris
KMNPVLQLISGMQSVLVMLEIMKASRLKLQMPTLSRSILRKQLN

SEQ ID NO: 1249 - protein, 8 aa, Canis lupus familiaris
KMNRSTTK

SEQ ID NO: 1250 - protein, 34 aa, Canis lupus familiaris
KMNRVTLMVWGGMLSPSLLGSGLFLWCMIPTGRL

SEQ ID NO: 1251 - protein, 37 aa, Canis lupus familiaris
KMNRVTLMVWGGMLSPSLLGSGLFLWCMIPTGRYFLH

SEQ ID NO: 1252 - protein, 63 aa, Canis lupus familiaris
KMNRVTLMVWGGMLSPSLLGSGLFLWCMIPTGSATRHLLMNLAQLCSLYTSLVIQPNAILTYF

SEQ ID NO: 1253 - protein, 9 aa, Canis lupus familiaris
KMNTLSKDS

SEQ ID NO: 1254 - protein, 82 aa, Canis lupus familiaris
KMPSFPYHPQFLHQMLSVNCQWILLMVSQVRRGSPSSTILTLNSCQLIFSVAVLRQYQFPLIQAQKGHLRIHSLLSPSMETI

SEQ ID NO: 1255 - protein, 26 aa, Canis lupus familiaris
KMQKKELQKRIKLVRMLPAVYLMVCQ

SEQ ID NO: 1256 - protein, 38 aa, Canis lupus familiaris
KMQLLFMTLNYRLQRPYWKLLMTWALMLFSTILILSLF

SEQ ID NO: 1257 - protein, 31 aa, Canis lupus familiaris
KMQTLLLIQRKHLLWQAADQEAKLRVMKRKG

SEQ ID NO: 1258 - protein, 8 aa, Canis lupus familiaris
KMQTRRQE

SEQ ID NO: 1259 - protein, 52 aa, Canis lupus familiaris
KMQVLLGLGESIRSSPLCHLLFLCLKMETKKIMDYHSLKINPQEPGPLENAL

SEQ ID NO: 1260 - protein, 13 aa, Canis lupus familiaris
KMRKLEFLQFSSY

SEQ ID NO: 1261 - skipped

SEQ ID NO: 1262 - protein, 15 aa, Canis lupus familiaris
KMRLFHLSWMKINPL

SEQ ID NO: 1263 - protein, 27 aa, Canis lupus familiaris
KMRLLMSRMKLDHYLAQSYPMTFLSRL

SEQ ID NO: 1264 - protein, 10 aa, Canis lupus familiaris
KMRLNFFIKI

SEQ ID NO: 1265 - protein, 11 aa, Canis lupus familiaris
KMRNRKICWIA

SEQ ID NO: 1266 - skipped

SEQ ID NO: 1267 - protein, 17 aa, Canis lupus familiaris
KMRPQRKGQSQQRSCIQ

SEQ ID NO: 1268 - protein, 9 aa, Canis lupus familiaris
KMRQIALWV

SEQ ID NO: 1269 - protein, 47 aa, Canis lupus familiaris
KMRRKRMPRRMKCPLMLILNLNGIQKRVNKMKKRIREFQKKTKINLQ

SEQ ID NO: 1270 - protein, 10 aa, Canis lupus familiaris
KMRSWREMQL

SEQ ID NO: 1271 - protein, 10 aa, Canis lupus familiaris
KMRTATLEKG

SEQ ID NO: 1272 - protein, 10 aa, Canis lupus familiaris
KMRVSQAARG

SEQ ID NO: 1273 - protein, 11 aa, Canis lupus familiaris
KMSALRSNSRH

SEQ ID NO: 1274 - protein, 11 aa, Canis lupus familiaris
KMSELTRSFSN

SEQ ID NO: 1275 - protein, 24 aa, Canis lupus familiaris
KMSFEIQQNSFKNIIGKDYAINSI

SEQ ID NO: 1276 - protein, 20 aa, Canis lupus familiaris
KMSFPKYSGIRIANLCFLTI

SEQ ID NO: 1277 - skipped

SEQ ID NO: 1278 - protein, 16 aa, Canis lupus familiaris
KMSQIFRKLETTLKLL

SEQ ID NO: 1279 - protein, 10 aa, Canis lupus familiaris
KMSQPFRPEK

SEQ ID NO: 1280 - protein, 11 aa, Canis lupus familiaris
KMSSSFPYGNN

SEQ ID NO: 1281 - protein, 20 aa, Canis lupus familiaris
KMSSTTLITRTLFFDLRCVQ

SEQ ID NO: 1282 - skipped

SEQ ID NO: 1283 - protein, 11 aa, Canis lupus familiaris
KMSSVSPNATH

SEQ ID NO: 1284 - protein, 32 aa, Canis lupus familiaris
KMTMTPKNTSCPQVLLIDPRVRNVWPISSNWW

SEQ ID NO: 1285 - protein, 11 aa, Canis lupus familiaris
KMTSQKIKMKK

SEQ ID NO: 1286 - protein, 25 aa, Canis lupus familiaris
KMTSVQMLLMIQILPTNIEMTVPVG

SEQ ID NO: 1287 - protein, 15 aa, Canis lupus familiaris
KMVATTSSVISGQWE

SEQ ID NO: 1288 - protein, 11 aa, Canis lupus familiaris
KMVFLHHCPQR

SEQ ID NO: 1289 - protein, 41 aa, Canis lupus familiaris
KMVITPFRWTLMLMKCSRKIFMTSGIPRALWLLPCCTISFW

SEQ ID NO: 1290 - protein, 31 aa, Canis lupus familiaris
KMVMQKLSGWIWKMMEKWTSYLNKCKMCCNH

SEQ ID NO: 1291 - protein, 16 aa, Canis lupus familiaris
KMVSFLCLPMTSSHDI

SEQ ID NO: 1292 - protein, 10 aa, Canis lupus familiaris
KMVSGLEQFF

SEQ ID NO: 1293 - protein, 15 aa, Canis lupus familiaris
KMVVLLLQLSMIQEV

SEQ ID NO: 1294 - skipped

SEQ ID NO: 1295 - protein, 22 aa, Canis lupus familiaris
KNICFKPIWTKTIRRCYFLYKN

SEQ ID NO: 1296 - protein, 9 aa, Canis lupus familiaris
KNLNMNIIV

SEQ ID NO: 1297 - skipped

SEQ ID NO: 1298 - protein, 15 aa, Canis lupus familiaris
KNNERRIALPATSDF

SEQ ID NO: 1299 - protein, 11 aa, Canis lupus familiaris
KNPHKEDTGAY

SEQ ID NO: 1300 - skipped

SEQ ID NO: 1301 - protein, 21 aa, Canis lupus familiaris
KNPTQKAPGSQARAGGKDQNC

SEQ ID NO: 1302 - protein, 18 aa, Canis lupus familiaris
KNSKALGSSRSSHLATVS

SEQ ID NO: 1303 - protein, 29 aa, Canis lupus familiaris
KNSLLKSYISDSRNSLLRTRRMMNRSLTG

SEQ ID NO: 1304 - protein, 12 aa, Canis lupus familiaris
KNSPYLLYDRLG

SEQ ID NO: 1305 - protein, 26 aa, Canis lupus familiaris
KNTGFGLEKRLITCQGPNPRKRPGPE

SEQ ID NO: 1306 - protein, 20 aa, Canis lupus familiaris
KPAKSSRRKSSLWGHNTTFD

SEQ ID NO: 1307 - protein, 14 aa, Canis lupus familiaris
KPALSVEGTSIKPE

SEQ ID NO: 1308 - protein, 13 aa, Canis lupus familiaris
KPAMLFTWFSHSR

SEQ ID NO: 1309 - protein, 17 aa, Canis lupus familiaris
KPARLLKRKEAIQIILN

SEQ ID NO: 1310 - protein, 21 aa, Canis lupus familiaris
KPASSQPLDRPQMQPPLARLT

SEQ ID NO: 1311 - protein, 26 aa, Canis lupus familiaris
KPAWIRTLQITLFQPWKTPGCFFIEL

SEQ ID NO: 1312 - protein, 28 aa, Canis lupus familiaris
KPCLCCRTVSAPSRSRGFETTRIFWEVW

SEQ ID NO: 1313 - protein, 16 aa, Canis lupus familiaris
KPCTKDHSESSSSFSR

SEQ ID NO: 1314 - protein, 23 aa, Canis lupus familiaris
KPEGAARHAQEPHREPQLQEDRV

SEQ ID NO: 1315 - protein, 14 aa, Canis lupus familiaris
KPERRHGTEDGEPQ

SEQ ID NO: 1316 - protein, 9 aa, Canis lupus familiaris
KPFLHAPLI

SEQ ID NO: 1317 - protein, 14 aa, Canis lupus familiaris
KPFLLTQKVASARG

SEQ ID NO: 1318 - protein, 59 aa, Canis lupus familiaris
KPFLTFISATWLWLIWSTSLECHFLFISGPGEESGCLGGPSAPLSHPWIPATSLPVVPS

SEQ ID NO: 1319 - protein, 34 aa, Canis lupus familiaris
KPFQRSEQLIFWIFLLGSSCLLSQEATMYSILRI

SEQ ID NO: 1320 - protein, 45 aa, Canis lupus familiaris
KPGLDCPGEQISKGLCQPRMTSEWRSSTRSQPLVERLRNTPPSSS

SEQ ID NO: 1321 - protein, 26 aa, Canis lupus familiaris
KPGNCGCRCLGLQRKRGLCNLDGWHR

SEQ ID NO: 1322 - protein, 64 aa, Canis lupus familiaris
KPHLPGPSRRSEGHSGKQVKAKQLLLQAGPYWSLLKPNLFFPTPQAATMTCEAKVVWDRGWWAK

SEQ ID NO: 1323 - protein, 78 aa, Canis lupus familiaris
KPHPFASTLEPRHRAGDFRIGVSLPSQSSDFSSWLFWMGAARCGLALIKPNRIHQMRGKSLWKPGTVVPAPLPSLSSM

SEQ ID NO: 1324 - skipped

SEQ ID NO: 1325 - protein, 64 aa, Canis lupus familiaris
KPHPFASTLEPRHRAGDFRIGVSLPSQSSDFSSWLFWMGAARCGLALIKPNRNFEECPAVSGYV

SEQ ID NO: 1326 - protein, 9 aa, Canis lupus familiaris
KPICKHLAL

SEQ ID NO: 1327 - protein, 66 aa, Canis lupus familiaris
KPILNLTGVSLWSPMVKSQCLRLFLQIQSVTRAPQHRLHIPVNTFQPGPRMLLSQGTKITGTQVPV

SEQ ID NO: 1328 - protein, 55 aa, Canis lupus familiaris
KPKALLILNSLYDKQQRGNKKLRNTRKTSSNRLRFSNMFLKVLRQSKAFNESFKF

SEQ ID NO: 1329 - protein, 19 aa, Canis lupus familiaris
KPKAPMTYLTGTGQVGGKE

SEQ ID NO: 1330 - protein, 10 aa, Canis lupus familiaris
KPKMKTQKTG

SEQ ID NO: 1331 - protein, 17 aa, Canis lupus familiaris
KPKNSRLMWLLLDFNME

SEQ ID NO: 1332 - protein, 21 aa, Canis lupus familiaris
KPKPVTRTQKTIKIKMPNLSL

SEQ ID NO: 1333 - protein, 51 aa, Canis lupus familiaris
KPKTSLFSGMPSVRAEGNRGVRAGIGQDDYAALIPLHHELQKSQGLGTIRI

SEQ ID NO: 1334 - protein, 13 aa, Canis lupus familiaris
KPLEQVHLEESCW

SEQ ID NO: 1335 - protein, 21 aa, Canis lupus familiaris
KPLKLQQPQLPRLHLRTLSST

SEQ ID NO: 1336 - protein, 18 aa, Canis lupus familiaris
KPLKSFRILTIFYQILKS

SEQ ID NO: 1337 - protein, 20 aa, Canis lupus familiaris
KPLLIQNKRTDHHLLYFQQS

SEQ ID NO: 1338 - protein, 9 aa, Canis lupus familiaris
KPLRKVRRP

SEQ ID NO: 1339 - protein, 12 aa, Canis lupus familiaris
KPLSRPVQFGEW

SEQ ID NO: 1340 - protein, 13 aa, Canis lupus familiaris
KPLSYFERNVATV

SEQ ID NO: 1341 - protein, 27 aa, Canis lupus familiaris
KPLTKGSCFGSYKGTGKPSSQRLQRYH

SEQ ID NO: 1342 - protein, 11 aa, Canis lupus familiaris
KPLVESSTSNL

SEQ ID NO: 1343 - protein, 32 aa, Canis lupus familiaris
KPMQRSKTRAEMRTTMKTKNGWKKKNRTKRRK

SEQ ID NO: 1344 - protein, 8 aa, Canis lupus familiaris
KPNASAEH

SEQ ID NO: 1345 - protein, 24 aa, Canis lupus familiaris
KPNDLSEYSNCFWSHSVKARERDW

SEQ ID NO: 1346 - protein, 10 aa, Canis lupus familiaris
KPNLFYEQPN

SEQ ID NO: 1347 - protein, 12 aa, Canis lupus familiaris
KPNSKPSLSKSV

SEQ ID NO: 1348 - protein, 18 aa, Canis lupus familiaris
KPPLKISSCLTRYYQGLI

SEQ ID NO: 1349 - protein, 37 aa, Canis lupus familiaris
KPPMLWICMSASCVAVATMKTGFSCVMGVTTVTTPFA

SEQ ID NO: 1350 - protein, 13 aa, Canis lupus familiaris
KPPRIFETRTVCT

SEQ ID NO: 1351 - protein, 22 aa, Canis lupus familiaris
KPQLTGTSNSTNREAEESVRKP

SEQ ID NO: 1352 - protein, 19 aa, Canis lupus familiaris
KPQWKEILWRDNMRQPGRP

SEQ ID NO: 1353 - skipped

SEQ ID NO: 1354 - protein, 10 aa, Canis lupus familiaris
KPRKFGDLRL

SEQ ID NO: 1355 - protein, 26 aa, Canis lupus familiaris
KPSCGSLPKNLIRSCSSGPMDRWLIL

SEQ ID NO: 1356 - protein, 34 aa, Canis lupus familiaris
KPSDGESPRGSQIRCRFHRINEGDGANAVAACQG

SEQ ID NO: 1357 - protein, 53 aa, Canis lupus familiaris
KPSEAGCRSLGTIKRPLGKTVRVAIAAHSLPQNLKTLLVSINRTFQIWTAMLW

SEQ ID NO: 1358 - protein, 13 aa, Canis lupus familiaris
KPSGRKSLMNRLL

SEQ ID NO: 1359 - protein, 19 aa, Canis lupus familiaris
KPSHPKSCPPKQGKYILIS

SEQ ID NO: 1360 - protein, 31 aa, Canis lupus familiaris
KPSKLRTPSKMSPSCPHRRPCIALSPQTYAA

SEQ ID NO: 1361 - protein, 74 aa, Canis lupus familiaris
KPSLCIEILFDIRVFILVGNFLDVRNVRRPIVLAQTLFSIRKFILVGSPMTVGNVGRPLVGLQTLFNMREFILN

SEQ ID NO: 1362 - protein, 57 aa, Canis lupus familiaris
KPSLLHLPKNIRKREGVDLVDPKNPFPLQCPKETSACPPASHCQWRLPRSGARPRQS

SEQ ID NO: 1363 - protein, 14 aa, Canis lupus familiaris
KPSLMVPKRNSTHT

SEQ ID NO: 1364 - protein, 25 aa, Canis lupus familiaris
KPSPLLDVLFRCLPPTLWGPQSVCS

SEQ ID NO: 1365-1366 - skipped (2 entries)

SEQ ID NO: 1367 - protein, 15 aa, Canis lupus familiaris
KPSRRIASGRSGLSW

SEQ ID NO: 1368 - skipped

SEQ ID NO: 1369 - protein, 42 aa, Canis lupus familiaris
KPSSPYSGPTPSTPELSSAAPNSSARWAESCCEQENQHAHIY

SEQ ID NO: 1370 - protein, 36 aa, Canis lupus familiaris
KPSSRSPTSLNTREHTLGRSPMNVTNVGNHSVISQP

SEQ ID NO: 1371 - protein, 10 aa, Canis lupus familiaris
KPSTQTGNYH

SEQ ID NO: 1372 - protein, 11 aa, Canis lupus familiaris
KPSVCLSNITW

SEQ ID NO: 1373 - protein, 30 aa, Canis lupus familiaris
KPSWLCCQTEVGKYPGKLLPEYPGAGEGKN

SEQ ID NO: 1374 - protein, 16 aa, Canis lupus familiaris
KPTLILHSFLTGISQR

SEQ ID NO: 1375 - protein, 23 aa, Canis lupus familiaris
KPVRLLFFTCTTMPLCLTSGGVF

SEQ ID NO: 1376 - protein, 59 aa, Canis lupus familiaris
KPVRSASKKWFLPKATQTPTQTAVKKKMRCPNTPLFLDLWLLSAPSHLGLCRNLAHIRI

SEQ ID NO: 1377 - protein, 13 aa, Canis lupus familiaris
KPVSPPETHTVGG

SEQ ID NO: 1378 - protein, 11 aa, Canis lupus familiaris
KPVTPQVNEGQ

SEQ ID NO: 1379 - protein, 24 aa, Canis lupus familiaris
KPVYSSFYECLHNERSRCSDSYSL

SEQ ID NO: 1380 - protein, 20 aa, Canis lupus familiaris
KPWKCTSIHGRIISMSSLKL

SEQ ID NO: 1381 - protein, 47 aa, Canis lupus familiaris
KPWYQLSIKSFRIRIMSFWNLSATSCLSSIVALKFDLRGSHCSSCQN

SEQ ID NO: 1382 - protein, 13 aa, Canis lupus familiaris
KPYRSDPWQTGHF

SEQ ID NO: 1383 - protein, 44 aa, Canis lupus familiaris
KQAAKCSLLPVPSTSLCSPLPRQFGSPTGLIPARSRNTAVLRKL

SEQ ID NO: 1384 - protein, 10 aa, Canis lupus familiaris
KQADFGITYS

SEQ ID NO: 1385 - protein, 36 aa, Canis lupus familiaris
KQAFLMQQITLTVEIQTWMKLLIPAVRIIKHQKREV

SEQ ID NO: 1386 - protein, 39 aa, Canis lupus familiaris
KQAFLMQQITLTVEIQTWMKLLIPAVRIIKHQKRNLPPQ

SEQ ID NO: 1387 - protein, 12 aa, Canis lupus familiaris
KQALKLQSLRRD

SEQ ID NO: 1388 - protein, 21 aa, Canis lupus familiaris
KQANYQSVKLQAFSKLIFRMV

SEQ ID NO: 1389 - protein, 39 aa, Canis lupus familiaris
KQARPKRGSRKNKEISKRNGNFRRPSSIQSSHKDFTSTE

SEQ ID NO: 1390 - protein, 15 aa, Canis lupus familiaris
KQCGISREQRQRNGL

SEQ ID NO: 1391 - protein, 17 aa, Canis lupus familiaris
KQCIKVILSWTFSITCT

SEQ ID NO: 1392 - protein, 10 aa, Canis lupus familiaris
KQCLQVAGSK

SEQ ID NO: 1393 - protein, 13 aa, Canis lupus familiaris
KQDGGERPGMEAP

SEQ ID NO: 1394 - protein, 22 aa, Canis lupus familiaris
KQDGWRTRSPEITGTPFERKGC

SEQ ID NO: 1395 - skipped

SEQ ID NO: 1396 - protein, 8 aa, Canis lupus familiaris
KQDPKPIN

SEQ ID NO: 1397 - protein, 17 aa, Canis lupus familiaris
KQDTPRSWLLRTTLEWS

SEQ ID NO: 1398 - protein, 13 aa, Canis lupus familiaris
KQDVMSSSYRSLS

SEQ ID NO: 1399 - protein, 9 aa, Canis lupus familiaris
KQEEKQSHV

SEQ ID NO: 1400 - skipped

SEQ ID NO: 1401 - protein, 20 aa, Canis lupus familiaris
KQEENRGRKCCQKGRGASGF

SEQ ID NO: 1402 - protein, 11 aa, Canis lupus familiaris
KQEGWIQVISA

SEQ ID NO: 1403 - protein, 12 aa, Canis lupus familiaris
KQEHTKFAQSDM

SEQ ID NO: 1404 - protein, 32 aa, Canis lupus familiaris
KQELQESEKPEVVVMIAGILGAMIEVLVVHVA

SEQ ID NO: 1405 - protein, 17 aa, Canis lupus familiaris
KQFGTLQRRIETNSGRA

SEQ ID NO: 1406 - protein, 13 aa, Canis lupus familiaris
KQFIGRHQKTEAR

SEQ ID NO: 1407 - protein, 60 aa, Canis lupus familiaris
KQFRLILRSETSKEEKEVILANVLFGSSAPLQTVRSGGGFVETLTLQCFQMIGPVIRIQT

SEQ ID NO: 1408 - protein, 27 aa, Canis lupus familiaris
KQFTIMQSLASALFSQQQMLLNNSLVK

SEQ ID NO: 1409 - protein, 32 aa, Canis lupus familiaris
KQGSFWAGGRRGVYYAGGLSFPQKVDSPPAAV

SEQ ID NO: 1410 - protein, 10 aa, Canis lupus familiaris
KQGTQKKPSF

SEQ ID NO: 1411 - protein, 13 aa, Canis lupus familiaris
KQGTQKKTRGFQH

SEQ ID NO: 1412 - protein, 46 aa, Canis lupus familiaris
KQHYIESVKKSLNLKMPVNHLDLTDQGFQKIQSELCGFSLLVPNSL

SEQ ID NO: 1413 - protein, 15 aa, Canis lupus familiaris
KQHYSKVAPGFQSFS

SEQ ID NO: 1414 - protein, 17 aa, Canis lupus familiaris
KQICQIIVRGLIEKKMI

SEQ ID NO: 1415 - protein, 14 aa, Canis lupus familiaris
KQICTRSENQHRGQ

SEQ ID NO: 1416 - protein, 10 aa, Canis lupus familiaris
KQIFIFHLLH

SEQ ID NO: 1417 - protein, 8 aa, Canis lupus familiaris
KQIHVKGI

SEQ ID NO: 1418 - protein, 15 aa, Canis lupus familiaris
KQIKWTLLQRWKVSD

SEQ ID NO: 1419 - protein, 9 aa, Canis lupus familiaris
KQISQHPSQ

SEQ ID NO: 1420 - protein, 9 aa, Canis lupus familiaris
KQIYEIYEN

SEQ ID NO: 1421 - protein, 21 aa, Canis lupus familiaris
KQKDISASKMSLNLERVILES

SEQ ID NO: 1422 - protein, 14 aa, Canis lupus familiaris
KQKFRPTLPPGNSF

SEQ ID NO: 1423 - protein, 12 aa, Canis lupus familiaris
KQKHQQRNRNAT

SEQ ID NO: 1424 - protein, 28 aa, Canis lupus familiaris
KQKHRIDHTIFCYLYSRSDISCINKNAF

SEQ ID NO: 1425 - skipped

SEQ ID NO: 1426 - protein, 23 aa, Canis lupus familiaris
KQKKMKIWRIKMRRQLVWMNPSA

SEQ ID NO: 1427 - protein, 14 aa, Canis lupus familiaris
KQKKQLKDSSWPIR

SEQ ID NO: 1428 - protein, 41 aa, Canis lupus familiaris
KQKKVKTRKTFLKGHHLVASNLHSPTLPVLLMEQIVQTVSL

SEQ ID NO: 1429 - protein, 40 aa, Canis lupus familiaris
KQKLVDMKVDWKTFQELVRLIFGIYLCPKNRLHKTSIQWT

SEQ ID NO: 1430 - protein, 20 aa, Canis lupus familiaris
KQKLVIFVWNILSHDPKVKK

SEQ ID NO: 1431 - skipped

SEQ ID NO: 1432 - protein, 36 aa, Canis lupus familiaris
KQKQPQRFRPGGVAPSYAGHCCTQLSVPGSFSAGGG

SEQ ID NO: 1433 - protein, 9 aa, Canis lupus familiaris
KQKRREARL

SEQ ID NO: 1434 - protein, 14 aa, Canis lupus familiaris
KQKRYLILMKLKKV

SEQ ID NO: 1435 - protein, 10 aa, Canis lupus familiaris
KQKSSITFAE

SEQ ID NO: 1436 - protein, 27 aa, Canis lupus familiaris
KQKTLKISVLISPMIFSLSQIQFIGKQ

SEQ ID NO: 1437 - protein, 13 aa, Canis lupus familiaris
KQKVQKKLLLKPR

SEQ ID NO: 1438 - skipped

SEQ ID NO: 1439 - protein, 33 aa, Canis lupus familiaris
KQLGPNHQLHHLLPPPHLVPELRRRHSLAKQGQ

SEQ ID NO: 1440 - protein, 25 aa, Canis lupus familiaris
KQLGPRPNCPIPGEGENPLPFHSFI

SEQ ID NO: 1441 - skipped

SEQ ID NO: 1442 - protein, 21 aa, Canis lupus familiaris
KQLKLIFQLQHQEKKPCLTKN

SEQ ID NO: 1443 - protein, 15 aa, Canis lupus familiaris
KQLMRKKSSSIYLIS

SEQ ID NO: 1444 - protein, 24 aa, Canis lupus familiaris
KQLRQSCGYQQMDSELWMKKLRTS

SEQ ID NO: 1445 - protein, 11 aa, Canis lupus familiaris
KQLSLTVKELG

SEQ ID NO: 1446 - protein, 11 aa, Canis lupus familiaris
KQLSRRNGQKL

SEQ ID NO: 1447 - protein, 38 aa, Canis lupus familiaris
KQLSWTARSLMWSSVLPTCSDRLASTKPPRSIMIWQPD

SEQ ID NO: 1448 - protein, 51 aa, Canis lupus familiaris
KQLWQLFHSFLRTSQSLCPRWKNLETVMCCLQPSLLQTPLHRKSLALLHPK

SEQ ID NO: 1449 - skipped

SEQ ID NO: 1450 - protein, 15 aa, Canis lupus familiaris
KQMNLLISSWLKSWR

SEQ ID NO: 1451 - skipped

SEQ ID NO: 1452 - protein, 56 aa, Canis lupus familiaris
KQNLIFKIYPVKRAATKKSILSPSALMMTKIISLVQKRKILSMMELPKVKKKKFMF

SEQ ID NO: 1453 - protein, 96 aa, Canis lupus familiaris
KQNLKLFGCFMQKTSSGLSLNSEKRSTTPTLRFFPRSSSSPMLRNPSLRHSRKKGESARRIVRRTWMSPLPWLISSINREPSRWSRTCLHILTSMN

SEQ ID NO: 1454 - protein, 12 aa, Canis lupus familiaris
KQNLLLLWHSLL

SEQ ID NO: 1455 - protein, 17 aa, Canis lupus familiaris
KQNLTLRIMDTQPWPPA

SEQ ID NO: 1456 - skipped

SEQ ID NO: 1457 - protein, 16 aa, Canis lupus familiaris
KQNQYGCETGAILFET

SEQ ID NO: 1458 - protein, 9 aa, Canis lupus familiaris
KQNRCSESR

SEQ ID NO: 1459 - protein, 20 aa, Canis lupus familiaris
KQNSVCIVNQQTSGKVNKIN

SEQ ID NO: 1460 - protein, 94 aa, Canis lupus familiaris
KQNTGVMFLKNIGTLILMTCLTTNWSLNISVSFLRLILQVWTLCAGQTLNSSEESFMETESRGKQNLYILKTNTLIKNISLAPKVQLLNISRTR

SEQ ID NO: 1461 - protein, 18 aa, Canis lupus familiaris
KQPFEKNRSLILKKKGLR

SEQ ID NO: 1462 - protein, 8 aa, Canis lupus familiaris
KQPNAFGE

SEQ ID NO: 1463 - protein, 32 aa, Canis lupus familiaris
KQPPQIHLVMTWKISPSMTLIKYSAGWWPQHQ

SEQ ID NO: 1464 - protein, 8 aa, Canis lupus familiaris
KQPRRRIC

SEQ ID NO: 1465 - protein, 46 aa, Canis lupus familiaris
KQPSRRTLLILSTMKPSSLIFPQRTWIKSACSSPSWIMIEWATTRS

SEQ ID NO: 1466 - protein, 51 aa, Canis lupus familiaris
KQPSYVQHETDGRKVTALRKGTARGRGAEPQGAAGAGRPDVRTAAAALAAA

SEQ ID NO: 1467 - protein, 22 aa, Canis lupus familiaris
KQQIQLVCQMYKLMILDKRKRK

SEQ ID NO: 1468 - protein, 11 aa, Canis lupus familiaris
KQQQASGPSNL

SEQ ID NO: 1469 - protein, 19 aa, Canis lupus familiaris
KQQRDQFHSSGLLPVGLRP

SEQ ID NO: 1470 - protein, 12 aa, Canis lupus familiaris
KQQTVLLAFLSS

SEQ ID NO: 1471 - protein, 13 aa, Canis lupus familiaris
KQRCYQLESQRQF

SEQ ID NO: 1472 - protein, 51 aa, Canis lupus familiaris
KQRDAGHLNKAPRKSITTQPTKSHDCLKPWCHIWPNSNESTRRNCGCHDEY

SEQ ID NO: 1473 - protein, 8 aa, Canis lupus familiaris
KQRDCSSP

SEQ ID NO: 1474 - protein, 11 aa, Canis lupus familiaris
KQRFLERYGIS

SEQ ID NO: 1475 - protein, 71 aa, Canis lupus familiaris
KQRHLLRLESLNLTQSLKQLVPLRVHRNHLLGKFRFRIRRWTSLRSPPNVGPRLTSSTNLVEETSRLKVRS

SEQ ID NO: 1476 - protein, 35 aa, Canis lupus familiaris
KQRHLLRLESLNLTQSLKQLVPLRVHRNHLLGKSR

SEQ ID NO: 1477 - protein, 11 aa, Canis lupus familiaris
KQRKETQRKAK

SEQ ID NO: 1478 - protein, 13 aa, Canis lupus familiaris
KQRKFKENTRATK

SEQ ID NO: 1479 - protein, 43 aa, Canis lupus familiaris
KQRKIMAILHGKGLISTGSSWKVPDGTHSREPLLKPASRRSPL

SEQ ID NO: 1480 - protein, 42 aa, Canis lupus familiaris
KQRKPKRANCVTQRKAKMWMCLSMILRKNSRRACCQRLMQRK

SEQ ID NO: 1481 - protein, 32 aa, Canis lupus familiaris
KQRKPLRKNGITTRKSYFMLWKTNILANIIRR

SEQ ID NO: 1482 - protein, 10 aa, Canis lupus familiaris
KQRKRRKFAH

SEQ ID NO: 1483 - protein, 21 aa, Canis lupus familiaris
KQRNLVFVLGLRYKPGRTRQG

SEQ ID NO: 1484 - skipped

SEQ ID NO: 1485 - protein, 11 aa, Canis lupus familiaris
KQRQYCSSKFW

SEQ ID NO: 1486 - protein, 9 aa, Canis lupus familiaris
KQRRIRILK

SEQ ID NO: 1487 - protein, 17 aa, Canis lupus familiaris
KQRSPLKRKLFLLKQKK

SEQ ID NO: 1488 - protein, 11 aa, Canis lupus familiaris
KQRWRRTRSSR

SEQ ID NO: 1489 - skipped

SEQ ID NO: 1490 - protein, 16 aa, Canis lupus familiaris
KQSCCSEKSEEADPEG

SEQ ID NO: 1491 - protein, 27 aa, Canis lupus familiaris
KQSCSNGKQSTKGKCWTYEALCGLITL

SEQ ID NO: 1492 - protein, 11 aa, Canis lupus familiaris
KQSFLKHRRKQ

SEQ ID NO: 1493 - protein, 9 aa, Canis lupus familiaris
KQSFSEINM

SEQ ID NO: 1494 - protein, 74 aa, Canis lupus familiaris
KQSLIFCIAKRRKYIKLLCIQMLLNKSTLTFTLENLQPRRLKHQPLRVLMKPKKLYILLWKRIPIPDFSNQIYI

SEQ ID NO: 1495 - protein, 10 aa, Canis lupus familiaris
KQSLKICARS

SEQ ID NO: 1496 - protein, 23 aa, Canis lupus familiaris
KQSQLSLGVHITLICLQVAVPII

SEQ ID NO: 1497 - protein, 9 aa, Canis lupus familiaris
KQSQNSPNS

SEQ ID NO: 1498 - protein, 15 aa, Canis lupus familiaris
KQSQTQPQSLRVEGN

SEQ ID NO: 1499 - protein, 11 aa, Canis lupus familiaris
KQSRIKSNCRI

SEQ ID NO: 1500 - protein, 15 aa, Canis lupus familiaris
KQSRTGCINCPLPQT

SEQ ID NO: 1501 - protein, 19 aa, Canis lupus familiaris
KQSRTLPSNFTSRFTSENH

SEQ ID NO: 1502 - protein, 9 aa, Canis lupus familiaris
KQSRTNLLL

SEQ ID NO: 1503 - protein, 10 aa, Canis lupus familiaris
KQSRVTSTAR

SEQ ID NO: 1504 - protein, 21 aa, Canis lupus familiaris
KQSSCRTSRKRRGHWPERFET

SEQ ID NO: 1505 - protein, 20 aa, Canis lupus familiaris
KQSTFFGEATNDRNIRSTKK

SEQ ID NO: 1506 - protein, 13 aa, Canis lupus familiaris
KQSTFWNPIQKRY

SEQ ID NO: 1507 - protein, 71 aa, Canis lupus familiaris
KQSYEPWRKEMVVCQGLVHVLTSASQHLRMECVDLCLKGGNGRCLFELQVQNLRAGVLAKLDGRLQKMEKL

SEQ ID NO: 1508 - protein, 10 aa, Canis lupus familiaris
KQTETEKTGK

SEQ ID NO: 1509 - protein, 36 aa, Canis lupus familiaris
KQTGPQKGNKVRKVSAFPHLTWVYTFFNLNFFSSEL

SEQ ID NO: 1510 - protein, 9 aa, Canis lupus familiaris
KQTKLQRHR

SEQ ID NO: 1511 - protein, 15 aa, Canis lupus familiaris
KQTKPSRAAVRPQDF

SEQ ID NO: 1512 - protein, 15 aa, Canis lupus familiaris
KQVCKCLLGDSLKKF

SEQ ID NO: 1513 - protein, 8 aa, Canis lupus familiaris
KQVFFQTT

SEQ ID NO: 1514 - protein, 25 aa, Canis lupus familiaris
KQVLLEVLVLVVCRAQPRSQDKRLC

SEQ ID NO: 1515 - protein, 35 aa, Canis lupus familiaris
KQVLRRNPHNLKAPFLLQNLMKILYGLPQVKDHMI

SEQ ID NO: 1516 - protein, 11 aa, Canis lupus familiaris
KQVNTQLLMRR

SEQ ID NO: 1517 - protein, 8 aa, Canis lupus familiaris
KQVWIITG

SEQ ID NO: 1518 - protein, 16 aa, Canis lupus familiaris
KQWKLYKLERKKRNLP

SEQ ID NO: 1519 - protein, 23 aa, Canis lupus familiaris
KQWTTYTVITHPSSLWPWSCGRL

SEQ ID NO: 1520 - protein, 13 aa, Canis lupus familiaris
KQYLPGLPFLPAS

SEQ ID NO: 1521 - protein, 12 aa, Canis lupus familiaris
KQYMIINLSLRE

SEQ ID NO: 1522 - protein, 41 aa, Canis lupus familiaris
KQYVPTQTGFSFSLLKRSFSSISSKKQYFPQSWSCIKSLSI

SEQ ID NO: 1523 - protein, 21 aa, Canis lupus familiaris
KRADMFTTNILKFCILTWSHR

SEQ ID NO: 1524 - protein, 36 aa, Canis lupus familiaris
KRAGNFVTVEIQSLVPKKSLPILFGSLRKQYMYSKM

SEQ ID NO: 1525 - protein, 58 aa, Canis lupus familiaris
KRALCICLHLLKNTAPMAFGHVPIIRLVRVSQMRIVEEGEKILDIANIAEERIEYGKT

SEQ ID NO: 1526 - protein, 64 aa, Canis lupus familiaris
KRALQVCSVSPPRLPSFTIYFCMVIPSLDFSLMSLLTFIMRLVCTWKTMACMKSFLGLFWGCSW

SEQ ID NO: 1527 - protein, 14 aa, Canis lupus familiaris
KRASCAPSGEVPPI

SEQ ID NO: 1528 - protein, 22 aa, Canis lupus familiaris
KRCGNPPTNYPGEGSASDRNQL

SEQ ID NO: 1529 - protein, 17 aa, Canis lupus familiaris
KRCQKKIFCKRLRKQKQ

SEQ ID NO: 1530 - protein, 52 aa, Canis lupus familiaris
KRDIKRTGTHWNLCWELWNTSLEPKGTSPQNVPLPTTPQPSRLTSILMKSLI

SEQ ID NO: 1531 - protein, 24 aa, Canis lupus familiaris
KRDIVKTSRIMSVSSPWMTCSPQS

SEQ ID NO: 1532 - protein, 16 aa, Canis lupus familiaris
KRDKRRKATRIQVLSV

SEQ ID NO: 1533 - protein, 22 aa, Canis lupus familiaris
KRDLPKLQVCHHHLQVFLRTLI

SEQ ID NO: 1534 - protein, 40 aa, Canis lupus familiaris
KRDLSFLGRNMIKPQNSVKPLKSVEKNFCCAEGWTYLSLF

SEQ ID NO: 1535 - protein, 39 aa, Canis lupus familiaris
KRDRLIHLRRKMMKKIMIMIKEVLVAKQLSMLAIKKMKK

SEQ ID NO: 1536 - protein, 94 aa, Canis lupus familiaris
KRDSTVKPRDFIIKRMVSQVPGSMTSFTNLQCSTMSHCLRKGHALFPLWPLSLAASRETTSLPEPGLCPKPREDFSLSLKQDLPQGITISMNPL

SEQ ID NO: 1537 - protein, 80 aa, Canis lupus familiaris
KRDVIPSVPLCPLLPRTQLEMRYLISMLLESRRICLLRRDCYCGHSRQQRVTLEYGVKISLPAGEMENYLMPSFINTGRT

SEQ ID NO: 1538 - skipped

SEQ ID NO: 1539 - protein, 15 aa, Canis lupus familiaris
KREINHSKQLPQKFC

SEQ ID NO: 1540 - skipped

SEQ ID NO: 1541 - protein, 14 aa, Canis lupus familiaris
KRELGCQLPPESEL

SEQ ID NO: 1542 - protein, 11 aa, Canis lupus familiaris
KREMPYHQGNP

SEQ ID NO: 1543 - protein, 28 aa, Canis lupus familiaris
KREMSFVNRTCKHQQIVAQIYLRKFSVL

SEQ ID NO: 1544 - protein, 8 aa, Canis lupus familiaris
KRESEKWM

SEQ ID NO: 1545 - protein, 8 aa, Canis lupus familiaris
KREWCVFD

SEQ ID NO: 1546 - protein, 24 aa, Canis lupus familiaris
KREYQGLENMTLKANFGRLKVYQV

SEQ ID NO: 1547 - protein, 16 aa, Canis lupus familiaris
KRFDRKLRSWHRKNCP

SEQ ID NO: 1548 - protein, 9 aa, Canis lupus familiaris
KRFESTIEN

SEQ ID NO: 1549 - protein, 11 aa, Canis lupus familiaris
KRFFRSRVQFV

SEQ ID NO: 1550 - protein, 30 aa, Canis lupus familiaris
KRFHCYTTFTLTFMNQTGGIWRARRRIDKC

SEQ ID NO: 1551 - protein, 65 aa, Canis lupus familiaris
KRFHQWLNSAAPQQKKWLKRFYAFWIQLPVQKAHLIIHFLSLHQLPYLRQRKILDDFIPILDMKI

SEQ ID NO: 1552 - protein, 29 aa, Canis lupus familiaris
KRFPHVHHLRKHTLYGVRHPQLVQTWPLR

SEQ ID NO: 1553 - protein, 9 aa, Canis lupus familiaris
KRFSFIFLQ

SEQ ID NO: 1554 - protein, 47 aa, Canis lupus familiaris
KRFTNWRNKGPLKFRRKGMGTLPYCQWWLLAHCPRGQKRQWVTLWDR

SEQ ID NO: 1555 - protein, 41 aa, Canis lupus familiaris
KRGGGRGQKNVLDSLIRLCLVSRGQKKIAESANFLISLKKM

SEQ ID NO: 1556 - protein, 38 aa, Canis lupus familiaris
KRGGLQGLLVAPRPALRTQPQRPRSPGLRVLGTQAWCY

SEQ ID NO: 1557 - protein, 26 aa, Canis lupus familiaris
KRGGTIFQTHVFRIPMDIFREFFAAT

SEQ ID NO: 1558 - protein, 44 aa, Canis lupus familiaris
KRGITSFPLFAPLLRLARSSLIHTQWIKMVKLYLLSLFLLQVLK

SEQ ID NO: 1559 - protein, 27 aa, Canis lupus familiaris
KRGKLYLVILMEVYQFFNQVIKVRSMF

SEQ ID NO: 1560 - protein, 57 aa, Canis lupus familiaris
KRGKTRCLIFIDLQQEEVISGERSMPFIVVTQLLLMKNALKEGNQRAWQEQEIDVCL

SEQ ID NO: 1561 - protein, 9 aa, Canis lupus familiaris
KRGWQVERL

SEQ ID NO: 1562 - protein, 68 aa, Canis lupus familiaris
KRHKRISSVNKLCIRQFWKRMLKILYTSTLCLRLDTSQSVIPKQKKTFIRFPPAKRRKVFMMCQKVNL

SEQ ID NO: 1563 - protein, 41 aa, Canis lupus familiaris
KRHLEKLRIKLTEHAQTKVTTLVERIPNLRSPQEKNNRMVT

SEQ ID NO: 1564 - protein, 15 aa, Canis lupus familiaris
KRHLKKKNQNQSRTP

SEQ ID NO: 1565 - protein, 9 aa, Canis lupus familiaris
KRHQLLREE

SEQ ID NO: 1566 - skipped

SEQ ID NO: 1567 - protein, 10 aa, Canis lupus familiaris
KRIIAILHGL

SEQ ID NO: 1568 - protein, 16 aa, Canis lupus familiaris
KRIPHLTVTSAAGPGA

SEQ ID NO: 1569 - protein, 19 aa, Canis lupus familiaris
KRIQRKMPRAQIMTTAWLL

SEQ ID NO: 1570 - protein, 15 aa, Canis lupus familiaris
KRIREFQKKTKINLQ

SEQ ID NO: 1571 - protein, 35 aa, Canis lupus familiaris
KRISQKEGNIIKRKKRREKRRSIHPLLILLRSPKS

SEQ ID NO: 1572 - protein, 17 aa, Canis lupus familiaris
KRISRRKDEALQKQPFA

SEQ ID NO: 1573 - protein, 10 aa, Canis lupus familiaris
KRIYRPEWNL

SEQ ID NO: 1574 - skipped

SEQ ID NO: 1575 - protein, 15 aa, Canis lupus familiaris
KRKCRQAITKRGFLF

SEQ ID NO: 1576 - protein, 20 aa, Canis lupus familiaris
KRKDLMTLWKMIKKRKNLVV

SEQ ID NO: 1577 - protein, 29 aa, Canis lupus familiaris
KRKEKNRMWCQKKLKVQNQGHLLMILLHN

SEQ ID NO: 1578 - protein, 41 aa, Canis lupus familiaris
KRKHGRGWSLKSALLETALQENHLNRKDSLGQWAYVSKRPM

SEQ ID NO: 1579 - protein, 9 aa, Canis lupus familiaris
KRKIRVFSK

SEQ ID NO: 1580 - protein, 71 aa, Canis lupus familiaris
KRKKAKPKNCLKKSLSKGSNCINKTGEKQNYMLTGERNNKKKIFFLQLLLLWIQTALIPISSYLRIENKFL

SEQ ID NO: 1581 - protein, 77 aa, Canis lupus familiaris
KRKKKKKRLKRIPTKPERRLSPSALGKVELEGSGLRLAKRILLLQSCQNCVHSSALRMEASPAALSVLVVGATSRVR

SEQ ID NO: 1582 - protein, 10 aa, Canis lupus familiaris
KRKKKTRIIM

SEQ ID NO: 1583 - protein, 34 aa, Canis lupus familiaris
KRKKLKNLFVWVNLRKRSPLVRLVFFFKFLSHVL

SEQ ID NO: 1584 - protein, 55 aa, Canis lupus familiaris
KRKKNHKDRGKKKRNLILMIKVHKFEHHLLPSPLHSLSKYTDKLKKARILLPPKA

SEQ ID NO: 1585 - skipped

SEQ ID NO: 1586 - protein, 9 aa, Canis lupus familiaris
KRKLKALLN

SEQ ID NO: 1587 - protein, 65 aa, Canis lupus familiaris
KRKMTKMLGKLRITPAKPPGKGASVGLLSNLPDCLAIAAHHGPGVISRSKICPSPRMTHSWHGVV

SEQ ID NO: 1588 - protein, 14 aa, Canis lupus familiaris
KRKMTKMLGKLRLK

SEQ ID NO: 1589 - protein, 29 aa, Canis lupus familiaris
KRKNLILYKTNLLIYINDLRKHLDNMGKF

SEQ ID NO: 1590 - protein, 15 aa, Canis lupus familiaris
KRKQWIFCILFSLVM

SEQ ID NO: 1591 - protein, 93 aa, Canis lupus familiaris
KRKRKKKRRANQEIKMKIKRTQRRKRRKKRKKRRKIKRRKAKIRKKRRRKRSWLLILQETCTITGCFASLYLLCTTGLWLLQEHVLMNFSLIT

SEQ ID NO: 1592 - protein, 36 aa, Canis lupus familiaris
KRKRKTKTKRKKRQKKRQRKRKRRRKKSLYFQLHPL

SEQ ID NO: 1593 - protein, 49 aa, Canis lupus familiaris
KRKRNHLETVQMYIKLVLIKVESTLFILIICQNPKRYFAIWILLGEVGL

SEQ ID NO: 1594 - protein, 49 aa, Canis lupus familiaris
KRKRNHLETVQMYIKLVLIKVESTLFILIICQNPKRYFAIWMSMGEVGL

SEQ ID NO: 1595 - protein, 35 aa, Canis lupus familiaris
KRKRRRRQKRPQPKTLTHYSRRKRRKRRRQQSKLS

SEQ ID NO: 1596 - protein, 34 aa, Canis lupus familiaris
KRKSHLCHDCIFRSQLVQSLKLAPYSHLRAWTHY

SEQ ID NO: 1597 - protein, 19 aa, Canis lupus familiaris
KRKSRGKSQSPFLPVPCPS

SEQ ID NO: 1598 - protein, 42 aa, Canis lupus familiaris
KRKTKNQWLASVSLRTASVQWEVPCSSDLSILPLSHRTKQGF

SEQ ID NO: 1599 - skipped

SEQ ID NO: 1600 - protein, 20 aa, Canis lupus familiaris
KRKWNCKKNLIGKSSNKSNG

SEQ ID NO: 1601 - protein, 8 aa, Canis lupus familiaris
KRLICSIL

SEQ ID NO: 1602 - protein, 11 aa, Canis lupus familiaris
KRLIFLLLDTW

SEQ ID NO: 1603 - protein, 18 aa, Canis lupus familiaris
KRLKAVEPPIFGVSNFSS

SEQ ID NO: 1604 - protein, 38 aa, Canis lupus familiaris
KRLKILQRFWIAMFRSKSLVPRWWWSPLVLAGMGMPFL

SEQ ID NO: 1605 - protein, 9 aa, Canis lupus familiaris
KRLKKPLKK

SEQ ID NO: 1606 - skipped

SEQ ID NO: 1607 - protein, 8 aa, Canis lupus familiaris
KRLKLANS

SEQ ID NO: 1608 - protein, 19 aa, Canis lupus familiaris
KRLKTSLSWMMISLPCIKF

SEQ ID NO: 1609 - protein, 12 aa, Canis lupus familiaris
KRLLLDRSTTRL

SEQ ID NO: 1610 - protein, 27 aa, Canis lupus familiaris
KRLLLGPLTCLCLLHQTSKSKKKSQWR

SEQ ID NO: 1611 - protein, 50 aa, Canis lupus familiaris
KRLMELNLLHQKRLKKKKNFSHKDLQTGLSEILTSLLKLMRSMEEMTLII

SEQ ID NO: 1612 - protein, 21 aa, Canis lupus familiaris
KRLNRLPQRRTTKTSSAICSS

SEQ ID NO: 1613 - protein, 8 aa, Canis lupus familiaris
KRLPNGER

SEQ ID NO: 1614 - protein, 59 aa, Canis lupus familiaris
KRLQRYYVTLVLSFLMKNLKMYGILHQKNTTEEKFVLKPSEMFWMSYNMQTESSVKQAC

SEQ ID NO: 1615 - protein, 26 aa, Canis lupus familiaris
KRLQVFVLSLIRKRKRRNVLDSETEK

SEQ ID NO: 1616 - protein, 12 aa, Canis lupus familiaris
KRLREIKVHSQK

SEQ ID NO: 1617 - protein, 8 aa, Canis lupus familiaris
KRLRGKLT

SEQ ID NO: 1618 - protein, 38 aa, Canis lupus familiaris
KRLRSTMSETAGYMPTCLRSLQNRMQRKRPVKPWARRL

SEQ ID NO: 1619 - protein, 9 aa, Canis lupus familiaris
KRLSRKKRN

SEQ ID NO: 1620 - protein, 22 aa, Canis lupus familiaris
KRLWGTYEIWPASLRIHKCCYT

SEQ ID NO: 1621 - skipped

SEQ ID NO: 1622 - protein, 42 aa, Canis lupus familiaris
KRMCSFMAVASRRLCGKQSLLWAHQLSQKTSPTGLFPKSLIS

SEQ ID NO: 1623 - protein, 24 aa, Canis lupus familiaris
KRMHPLLLQIKPLLHPRLKIEHTM

SEQ ID NO: 1624-1625 - skipped (2 entries)

SEQ ID NO: 1626 - protein, 35 aa, Canis lupus familiaris
KRNCEWSSIEREKLEKTLKDNLQLSFKAELPCKNV

SEQ ID NO: 1627 - skipped

SEQ ID NO: 1628 - protein, 36 aa, Canis lupus familiaris
KRNGHELNKCWQILLSKWTSGLEMQIYTKIDFFESK

SEQ ID NO: 1629 - protein, 8 aa, Canis lupus familiaris
KRNKRKHH

SEQ ID NO: 1630 - protein, 10 aa, Canis lupus familiaris
KRNKRKRWKF

SEQ ID NO: 1631 - protein, 11 aa, Canis lupus familiaris
KRNLHYVQLHV

SEQ ID NO: 1632 - protein, 16 aa, Canis lupus familiaris
KRNLRGKAPLHHPTLT

SEQ ID NO: 1633 - protein, 26 aa, Canis lupus familiaris
KRNMKRKRKRSKKSRQNVSKKKKLPS

SEQ ID NO: 1634 - protein, 12 aa, Canis lupus familiaris
KRNMRNKLRSIT

SEQ ID NO: 1635 - skipped

SEQ ID NO: 1636 - protein, 29 aa, Canis lupus familiaris
KRNRDNRPHHCPHHFSSRAHVSLILRTVV

SEQ ID NO: 1637 - protein, 12 aa, Canis lupus familiaris
KRNSARCIWRTL

SEQ ID NO: 1638 - protein, 23 aa, Canis lupus familiaris
KRNSWSRIAGRQWISNSSSQRKN

SEQ ID NO: 1639 - protein, 10 aa, Canis lupus familiaris
KRNVELGLPG

SEQ ID NO: 1640 - protein, 13 aa, Canis lupus familiaris
KRNYRINFKVPLL

SEQ ID NO: 1641 - protein, 61 aa, Canis lupus familiaris
KRNYVKHYGNLKKHFINRMEGMPRKRIVFQCLKSIGSTRKLKPNLGFLKFLSANKILQNPY

SEQ ID NO: 1642 - protein, 8 aa, Canis lupus familiaris
KRPHPFCW

SEQ ID NO: 1643 - protein, 32 aa, Canis lupus familiaris
KRPLMKSLRIRDLHYIHLQKKQRLWRKLFLQM

SEQ ID NO: 1644 - protein, 10 aa, Canis lupus familiaris
KRPLRPFSYS

SEQ ID NO: 1645 - protein, 12 aa, Canis lupus familiaris
KRPNNQNIGGSG

SEQ ID NO: 1646 - protein, 27 aa, Canis lupus familiaris
KRPRSWHLQHTRILQTPKCFRWYSRGL

SEQ ID NO: 1647 - protein, 47 aa, Canis lupus familiaris
KRPSPLLDVSSNFISFSLWELLNVCSWPSWPLIGTLLSAVPCTTLIS

SEQ ID NO: 1648 - protein, 15 aa, Canis lupus familiaris
KRQKIGNQDGKTRNY

SEQ ID NO: 1649 - protein, 9 aa, Canis lupus familiaris
KRQNLYQKR

SEQ ID NO: 1650 - protein, 21 aa, Canis lupus familiaris
KRQRKRKRRRKKSLYFQLHPL

SEQ ID NO: 1651 - protein, 16 aa, Canis lupus familiaris
KRQRMTAGGWLRALRT

SEQ ID NO: 1652 - protein, 20 aa, Canis lupus familiaris
KRQRTQRNQMNPTEITSSRP

SEQ ID NO: 1653 - protein, 30 aa, Canis lupus familiaris
KRQRVVKNMLHQESHLESKMDHFLTLILPW

SEQ ID NO: 1654 - protein, 43 aa, Canis lupus familiaris
KRQRVVKNMLHQESHLESKMDHFLTLMWVTSSPPSFEVSSLPW

SEQ ID NO: 1655 - protein, 20 aa, Canis lupus familiaris
KRRAEWTSGRTRRQPRPPGC

SEQ ID NO: 1656 - protein, 41 aa, Canis lupus familiaris
KRRDKNHLPVGNEGLLRDGFYHRPCQFPDRSVVSRPDSHRK

SEQ ID NO: 1657 - protein, 9 aa, Canis lupus familiaris
KRREKRRKH

SEQ ID NO: 1658 - protein, 21 aa, Canis lupus familiaris
KRREKRRSIHPLLILLRSPKS

SEQ ID NO: 1659 - protein, 56 aa, Canis lupus familiaris
KRRGAVLQGSVPGRGGPGHRSQELRFCIPLSHPQNHHCPRDGHSRHLSAAGHPGLQ

SEQ ID NO: 1660 - protein, 29 aa, Canis lupus familiaris
KRRGGRVQRRRTASAPLPRPSELHPQRST

SEQ ID NO: 1661 - protein, 15 aa, Canis lupus familiaris
KRRKNKKQPTFFLWQ

SEQ ID NO: 1662 - protein, 17 aa, Canis lupus familiaris
KRRKRKAMRQIQPRISL

SEQ ID NO: 1663 - protein, 10 aa, Canis lupus familiaris
KRRLYHKKLR

SEQ ID NO: 1664 - protein, 14 aa, Canis lupus familiaris
KRRMRLDRRTQKTA

SEQ ID NO: 1665 - protein, 15 aa, Canis lupus familiaris
KRRNAASTKLKKLKP

SEQ ID NO: 1666 - protein, 10 aa, Canis lupus familiaris
KRRNMGKKCP

SEQ ID NO: 1667 - protein, 14 aa, Canis lupus familiaris
KRRNVTKILFLWLP

SEQ ID NO: 1668 - protein, 8 aa, Canis lupus familiaris
KRRPQIRP

SEQ ID NO: 1669 - protein, 63 aa, Canis lupus familiaris
KRRQTTCSSNLQASLRNPLTRNVEEVMRGRLRFFQGLGSSCRRPGALIFLPERTPRSQNQRRN

SEQ ID NO: 1670 - protein, 72 aa, Canis lupus familiaris
KRRRGAHGHGPSPRPGPSRRPQASKPHVGTRPTQPASLPWRVGAPVRSAPGEFLRKKTARSPQQLSPLCRAK

SEQ ID NO: 1671 - protein, 44 aa, Canis lupus familiaris
KRRRGHASEFISEKNTDSQRVKWTRTKSRWPETMWTCPKISGKW

SEQ ID NO: 1672 - protein, 27 aa, Canis lupus familiaris
KRRRGILPCCQRTPYLQNFFKYIKNTL

SEQ ID NO: 1673 - protein, 15 aa, Canis lupus familiaris
KRRRNQRCLTFQLFI

SEQ ID NO: 1674 - protein, 71 aa, Canis lupus familiaris
KRRRRKRRKRKRSTRNISTEAQVVMVAVARMSAVGGDLKRSWQILPLCCPKPLDMAYRSGTPVIAREYRVL

SEQ ID NO: 1675 - protein, 19 aa, Canis lupus familiaris
KRRRRQSGGKKGREMGDKR

SEQ ID NO: 1676 - protein, 20 aa, Canis lupus familiaris
KRRRRQSGGKKGREMGDKSR

SEQ ID NO: 1677 - protein, 16 aa, Canis lupus familiaris
KRRTSFSPTIHLFFDP

SEQ ID NO: 1678 - protein, 22 aa, Canis lupus familiaris
KRSCPSSLSVFSALGYHLYYFK

SEQ ID NO: 1679 - protein, 11 aa, Canis lupus familiaris
KRSEDFLLGMF

SEQ ID NO: 1680 - protein, 24 aa, Canis lupus familiaris
KRSGERKIYKYNCILKELSLPLPQ

SEQ ID NO: 1681 - protein, 10 aa, Canis lupus familiaris
KRSGSKPHKL

SEQ ID NO: 1682 - protein, 9 aa, Canis lupus familiaris
KRSGSVLSV

SEQ ID NO: 1683 - protein, 8 aa, Canis lupus familiaris
KRSHILSP

SEQ ID NO: 1684 - protein, 14 aa, Canis lupus familiaris
KRSISGFSPTVSGV

SEQ ID NO: 1685 - protein, 10 aa, Canis lupus familiaris
KRSLEVKTSS

SEQ ID NO: 1686 - skipped

SEQ ID NO: 1687 - protein, 50 aa, Canis lupus familiaris
KRSLQSSHLTEGWWQRRSCRRCTGLRFSSRPLTECTEHMLHFRPGNMPPF

SEQ ID NO: 1688 - protein, 13 aa, Canis lupus familiaris
KRSLTKRQKRTIV

SEQ ID NO: 1689 - protein, 44 aa, Canis lupus familiaris
KRSPIRGEGPCLSVKPVETGIENWRILKTIRNFTAQSYTDQKQR

SEQ ID NO: 1690 - protein, 75 aa, Canis lupus familiaris
KRSQNLKWGSFTCSKILKFQRSACQFIPLLQMLQNNVMNVEKSQKLQTLEIRLKTQLFSISYNQELTVGYEKFKK

SEQ ID NO: 1691 - protein, 22 aa, Canis lupus familiaris
KRSRGKGKTCPNSQRIGRERKT

SEQ ID NO: 1692 - protein, 35 aa, Canis lupus familiaris
KRSRGSALMMMMMKKMEVTCTRLFLLPRSVIAWRS

SEQ ID NO: 1693 - protein, 23 aa, Canis lupus familiaris
KRSRIPWRLDTRPSCPRNPCHSS

SEQ ID NO: 1694 - protein, 12 aa, Canis lupus familiaris
KRSSCSTGNQSL

SEQ ID NO: 1695 - protein, 10 aa, Canis lupus familiaris
KRSSLQLFLL

SEQ ID NO: 1696 - protein, 20 aa, Canis lupus familiaris
KRSTWGLKILEKGNEHEVQR

SEQ ID NO: 1697 - protein, 83 aa, Canis lupus familiaris
KRSVCSYAGSWGTALGRGRSLWRRRKRWLFAQTVRAATIPLARRRRRSLDLRKKRRANPSGRKRKKRMTTTMIQRSLNHLLSS

SEQ ID NO: 1698 - protein, 76 aa, Canis lupus familiaris
KRSWGTALGRGRSLWRRRKRWLFAQTVRAATIPLARRRRRSLDLRKKRRANPSGRKRKKRMTTTMIQRSLNHLLSS

SEQ ID NO: 1699 - protein, 11 aa, Canis lupus familiaris
KRTAVAAAYLA

SEQ ID NO: 1700 - protein, 29 aa, Canis lupus familiaris
KRTELPRPHREIPHIQGYCLHLGQPAAEI

SEQ ID NO: 1701 - protein, 47 aa, Canis lupus familiaris
KRTGLCLSQHPSPCIMLPAVTWTLALVTASAWPAPSARIVWPLMSLT

SEQ ID NO: 1702 - protein, 61 aa, Canis lupus familiaris
KRTHRQHRKIKLNKTRKALNQLVRLLQVASKKPGNQNFQLALTLSNFTVNFVNVSLLPNRT

SEQ ID NO: 1703 - protein, 30 aa, Canis lupus familiaris
KRTKASSSEPPVSLSPGHRKQTCLRQRYHK

SEQ ID NO: 1704 - protein, 11 aa, Canis lupus familiaris
KRTKQMRVLSG

SEQ ID NO: 1705 - protein, 36 aa, Canis lupus familiaris
KRTLKPINTSIYILRVSSPWEAAWWRPRKNPACPMP

SEQ ID NO: 1706 - protein, 21 aa, Canis lupus familiaris
KRTMVLILLKVLHKSKQLMTI

SEQ ID NO: 1707 - protein, 22 aa, Canis lupus familiaris
KRTSRKTKPTGLPTTVSRLPCV

SEQ ID NO: 1708 - skipped

SEQ ID NO: 1709 - protein, 19 aa, Canis lupus familiaris
KRTTVYCTLFPAPCDFSMS

SEQ ID NO: 1710 - protein, 34 aa, Canis lupus familiaris
KRVAYHLLSSSFLSLAALLRELPSWLSLELTQNI

SEQ ID NO: 1711 - protein, 45 aa, Canis lupus familiaris
KRVFSPRDSARPCARFPCLELCVTIRASPPFRGTSSGPTFSHGAL

SEQ ID NO: 1712 - protein, 15 aa, Canis lupus familiaris
KRVFVPTNVVRCCRL

SEQ ID NO: 1713 - protein, 27 aa, Canis lupus familiaris
KRVGHYQKLLISPHVERSTVFSTNRSF

SEQ ID NO: 1714 - protein, 10 aa, Canis lupus familiaris
KRVIHIVVLE

SEQ ID NO: 1715 - protein, 73 aa, Canis lupus familiaris
KRVLFPADGSAGRGDRLEAAAPRGLHAEAPHCCRSPSDSIICLCRRAKYRHSQLCGNFYQRGQRPSDQREFEH

SEQ ID NO: 1716 - protein, 97 aa, Canis lupus familiaris
KRVLVPTDPVEKRERPVQVWRPRRLQRPRLQVTAQRRSQESKKRQRKKETLHWGKKTQDRRPKSQEPGSLLLLINLQKKLPTPPNSGPKSAKYPSQP

SEQ ID NO: 1717 - protein, 14 aa, Canis lupus familiaris
KRVTTYLNISKGTQ

SEQ ID NO: 1718 - protein, 12 aa, Canis lupus familiaris
KRWGGTHSQPAR

SEQ ID NO: 1719 - skipped

SEQ ID NO: 1720 - protein, 16 aa, Canis lupus familiaris
KRWKKLSRKQKRCKKR

SEQ ID NO: 1721 - protein, 8 aa, Canis lupus familiaris
KRWKKSGG

SEQ ID NO: 1722 - skipped

SEQ ID NO: 1723 - protein, 12 aa, Canis lupus familiaris
KRYERHRLRRAC

SEQ ID NO: 1724 - protein, 12 aa, Canis lupus familiaris
KRYRSVLRPSSA

SEQ ID NO: 1725 - protein, 15 aa, Canis lupus familiaris
KRYSLLKALAENSLS

SEQ ID NO: 1726 - protein, 24 aa, Canis lupus familiaris
KRYVIRKKILKEKIMKSYYKMRFL

SEQ ID NO: 1727 - protein, 15 aa, Canis lupus familiaris
KRYWRRYKSWRRSPE

SEQ ID NO: 1728 - protein, 22 aa, Canis lupus familiaris
KSAAPADAMQTAAEEYDGKQGI

SEQ ID NO: 1729 - skipped

SEQ ID NO: 1730 - protein, 17 aa, Canis lupus familiaris
KSANKGICLVQGRLGHH

SEQ ID NO: 1731 - skipped

SEQ ID NO: 1732 - protein, 21 aa, Canis lupus familiaris
KSAPIAFTANFSHMPLKHFTT

SEQ ID NO: 1733 - protein, 43 aa, Canis lupus familiaris
KSASTRAETHSLAGSRWWSTRVPSRHLMLCSITYQGRCLYLSG

SEQ ID NO: 1734 - protein, 53 aa, Canis lupus familiaris
KSAWTLRRRVYPVLLYERSPCLRSLTTRTLSSYWMSSTQKTNSTWFLNFCTRI

SEQ ID NO: 1735 - protein, 14 aa, Canis lupus familiaris
KSAYYEAPQGGSYV

SEQ ID NO: 1736 - protein, 11 aa, Canis lupus familiaris
KSAYYSAEATV

SEQ ID NO: 1737 - protein, 15 aa, Canis lupus familiaris
KSCFMLEKTENKIVW

SEQ ID NO: 1738 - protein, 16 aa, Canis lupus familiaris
KSCGTVFISETDRLAK

SEQ ID NO: 1739 - protein, 13 aa, Canis lupus familiaris
KSCRKPISLFWSY

SEQ ID NO: 1740 - protein, 10 aa, Canis lupus familiaris
KSCSMLPIIF

SEQ ID NO: 1741 - protein, 28 aa, Canis lupus familiaris
KSDGGPGGKYFKRVAVVSQGCNQEAGHR

SEQ ID NO: 1742 - protein, 14 aa, Canis lupus familiaris
KSDQQKIKPGNQAS

SEQ ID NO: 1743 - protein, 26 aa, Canis lupus familiaris
KSEALYSSTAASREKGEDSEAQSQTW

SEQ ID NO: 1744 - skipped

SEQ ID NO: 1745 - protein, 17 aa, Canis lupus familiaris
KSEQRWRISSSTFLSFK

SEQ ID NO: 1746 - protein, 31 aa, Canis lupus familiaris
KSEVQSCLLSMLHGCLNNSRPLEIYLMKLLS

SEQ ID NO: 1747 - protein, 8 aa, Canis lupus familiaris
KSEWGETL

SEQ ID NO: 1748 - protein, 11 aa, Canis lupus familiaris
KSFKGFEKNKP

SEQ ID NO: 1749 - protein, 24 aa, Canis lupus familiaris
KSFLERPPYQVLNPSSMQEISKKN

SEQ ID NO: 1750 - protein, 51 aa, Canis lupus familiaris
KSFRRGKLLIRGKGLLSFSAPRCASLDIQFHLPAHRLLPPRKLVQAAQKIF

SEQ ID NO: 1751 - protein, 49 aa, Canis lupus familiaris
KSFRRGKLPIRGKGLLSFSAPRCASMSTFHLPIHQLFPRELVQTAQKTS

SEQ ID NO: 1752 - protein, 14 aa, Canis lupus familiaris
KSFSETFHLAQWTL

SEQ ID NO: 1753 - protein, 11 aa, Canis lupus familiaris
KSFSKRHEMDP

SEQ ID NO: 1754 - protein, 43 aa, Canis lupus familiaris
KSGCSSGEAKRRRCRENERNCLSACARCCHDNQEGSCKHKKTV

SEQ ID NO: 1755 - protein, 37 aa, Canis lupus familiaris
KSGKDMQTFLENCTLLSLKRIRMDLDSALLVIKTDHA

SEQ ID NO: 1756 - protein, 11 aa, Canis lupus familiaris
KSGKSYSRILC

SEQ ID NO: 1757 - protein, 26 aa, Canis lupus familiaris
KSGKVRLGVVILHKIRRFLITMLKGI

SEQ ID NO: 1758 - protein, 16 aa, Canis lupus familiaris
KSGNIYLMRIGTTRCN

SEQ ID NO: 1759 - protein, 9 aa, Canis lupus familiaris
KSGPVLNSP

SEQ ID NO: 1760 - protein, 8 aa, Canis lupus familiaris
KSGQIFSK

SEQ ID NO: 1761 - protein, 10 aa, Canis lupus familiaris
KSGRLNLLTF

SEQ ID NO: 1762 - protein, 16 aa, Canis lupus familiaris
KSGRLQKRWQTRFHVQ

SEQ ID NO: 1763 - protein, 42 aa, Canis lupus familiaris
KSGRYENEWSSPVIEYCLCCKGQVETGGAAKGFPGVPSAFQP

SEQ ID NO: 1764 - protein, 12 aa, Canis lupus familiaris
KSGSCRRKACCK

SEQ ID NO: 1765 - protein, 12 aa, Canis lupus familiaris
KSGTAISKLSTL

SEQ ID NO: 1766 - protein, 36 aa, Canis lupus familiaris
KSHCLRQPMLRPRKPRPAVPEIPAHLRHSPRPTSWA

SEQ ID NO: 1767 - protein, 22 aa, Canis lupus familiaris
KSHERQFCIKVLGEIFRIPCTA

SEQ ID NO: 1768 - protein, 51 aa, Canis lupus familiaris
KSHISVMTVENFSARWHILLNIRGSIPKKNPINVVSAKKHLVRIQPLFDIS

SEQ ID NO: 1769 - skipped

SEQ ID NO: 1770 - protein, 20 aa, Canis lupus familiaris
KSHQHCDNNIALPFKSENNG

SEQ ID NO: 1771 - protein, 29 aa, Canis lupus familiaris
KSHRRTQLLKGKTPFCPWALVKIMIQQQQ

SEQ ID NO: 1772 - protein, 57 aa, Canis lupus familiaris
KSHSLRPRRDKGLPCRHNITREPPLTHPELNTEEQGRKTSAFVSAVLPTPTQWSHQH

SEQ ID NO: 1773 - protein, 8 aa, Canis lupus familiaris
KSHSYQRC

SEQ ID NO: 1774 - protein, 32 aa, Canis lupus familiaris
KSIFSKCSKCFRSWDMTGQKGASTCPLEWCRE

SEQ ID NO: 1775 - protein, 34 aa, Canis lupus familiaris
KSIIHKNSLPPPTPKDVENPANLLVLLVVKIFAR

SEQ ID NO: 1776 - protein, 13 aa, Canis lupus familiaris
KSIKDSQKNLSQR

SEQ ID NO: 1777 - protein, 83 aa, Canis lupus familiaris
KSIKRKRNKEGVDQEVLVVVVPVAIAELVVLVVLSLALHIVLAQVVVALLLDLLLLKGKKDIVGVDLQQLKLDGVEVEVTHAE

SEQ ID NO: 1778 - protein, 23 aa, Canis lupus familiaris
KSILERNTLNVLNVEKPSQGNQL

SEQ ID NO: 1779 - protein, 14 aa, Canis lupus familiaris
KSILLIKAVILDTH

SEQ ID NO: 1780 - protein, 17 aa, Canis lupus familiaris
KSINFFKNTWITLRNFT

SEQ ID NO: 1781 - protein, 11 aa, Canis lupus familiaris
KSIQTQPKIQL

SEQ ID NO: 1782 - protein, 10 aa, Canis lupus familiaris
KSISRALKRA

SEQ ID NO: 1783 - protein, 31 aa, Canis lupus familiaris
KSISVITQGDFISALLSWVLGDLVLAGITGK

SEQ ID NO: 1784 - protein, 27 aa, Canis lupus familiaris
KSITTSISPYLPRSKSSPVRWRGVHGP

SEQ ID NO: 1785 - protein, 66 aa, Canis lupus familiaris
KSIYTMTMTITPTMITTLTVIMLLPIKIIGKLFVQTMNLIVWVRIPETARGKDLTDQSMPMVKGMF

SEQ ID NO: 1786 - protein, 12 aa, Canis lupus familiaris
KSKAKQRMKNQE

SEQ ID NO: 1787 - protein, 18 aa, Canis lupus familiaris
KSKCLRQLNRPRDLCERH

SEQ ID NO: 1788 - protein, 12 aa, Canis lupus familiaris
KSKCMISIKKEV

SEQ ID NO: 1789 - protein, 12 aa, Canis lupus familiaris
KSKCYKNFTEQS

SEQ ID NO: 1790 - protein, 27 aa, Canis lupus familiaris
KSKFSKTPSQANSQNLAKMQRRLGPVR

SEQ ID NO: 1791 - protein, 19 aa, Canis lupus familiaris
KSKICDASQSGTLNGNAFI

SEQ ID NO: 1792 - protein, 9 aa, Canis lupus familiaris
KSKMTKQSI

SEQ ID NO: 1793 - protein, 11 aa, Canis lupus familiaris
KSKPFKVKMQK

SEQ ID NO: 1794 - protein, 9 aa, Canis lupus familiaris
KSKRMEEKV

SEQ ID NO: 1795 - protein, 23 aa, Canis lupus familiaris
KSKSALKKMLLHESKGRKDGGDY

SEQ ID NO: 1796 - protein, 18 aa, Canis lupus familiaris
KSKTLLKCLTTRRIIQWM

SEQ ID NO: 1797 - protein, 24 aa, Canis lupus familiaris
KSKTSFILMWKSLTGCPVWSLPIG

SEQ ID NO: 1798 - protein, 27 aa, Canis lupus familiaris
KSKVMVKLLKKKRKLNLRKRVKKKLKS

SEQ ID NO: 1799 - protein, 12 aa, Canis lupus familiaris
KSLAGLGIGPQS

SEQ ID NO: 1800 - protein, 20 aa, Canis lupus familiaris
KSLFRTGKPKSSKRRRKFSS

SEQ ID NO: 1801 - protein, 14 aa, Canis lupus familiaris
KSLGGDMKFLHFSY

SEQ ID NO: 1802 - protein, 24 aa, Canis lupus familiaris
KSLHLVSTILLRKTTRLLMQISEN

SEQ ID NO: 1803 - protein, 29 aa, Canis lupus familiaris
KSLILFLQLIIQRLTIHHLKKIFTMSMKR

SEQ ID NO: 1804 - protein, 16 aa, Canis lupus familiaris
KSLILYLKSFSSEHPK

SEQ ID NO: 1805 - protein, 16 aa, Canis lupus familiaris
KSLKRSKNSVKKRRHS

SEQ ID NO: 1806 - protein, 38 aa, Canis lupus familiaris
KSLKTLRRKKKMRMSRNQDLQIGPESPNPEAEEWNGRS

SEQ ID NO: 1807 - protein, 26 aa, Canis lupus familiaris
KSLLGFQVPLGCQLQAAAARSKEPLI

SEQ ID NO: 1808 - protein, 67 aa, Canis lupus familiaris
KSLLKRNMKLSWISAKNFSQFSVTSAWKSSWTQLFGLRSDWLILAVWPLPRLLVTYLDLVIDMCRIS

SEQ ID NO: 1809 - protein, 14 aa, Canis lupus familiaris
KSLLKTLRILKICI

SEQ ID NO: 1810 - protein, 42 aa, Canis lupus familiaris
KSLMSALSATRLSPPNRTTSSTCSYTQVRSPTNAASVGAPSP

SEQ ID NO: 1811 - protein, 8 aa, Canis lupus familiaris
KSLNQRLS

SEQ ID NO: 1812 - protein, 9 aa, Canis lupus familiaris
KSLNTSVDS

SEQ ID NO: 1813 - protein, 83 aa, Canis lupus familiaris
KSLPTWPCVPLRPNHPEAWHPCPTLESCTKLTTPRPGLYYHCGPSPSISSGTGESPGRAGYTEASRGRRVYRITCTEWQLWLW

SEQ ID NO: 1814 - protein, 18 aa, Canis lupus familiaris
KSLQFCINIWMTINHSSY

SEQ ID NO: 1815 - protein, 13 aa, Canis lupus familiaris
KSLRKNRLLKDWK

SEQ ID NO: 1816 - protein, 24 aa, Canis lupus familiaris
KSLRLTLAKFRPKKEGRYLTLWHH

SEQ ID NO: 1817 - protein, 48 aa, Canis lupus familiaris
KSLRNMSAMMKLLRKMRGLWVCPLFYKPIMLWKEWKNLFVRYGKVDGE

SEQ ID NO: 1818 - protein, 9 aa, Canis lupus familiaris
KSLRTIFDG

SEQ ID NO: 1819 - protein, 9 aa, Canis lupus familiaris
KSLSQKDME

SEQ ID NO: 1820 - protein, 11 aa, Canis lupus familiaris
KSLSQRSYARL

SEQ ID NO: 1821 - protein, 14 aa, Canis lupus familiaris
KSLTALITHTLCCW

SEQ ID NO: 1822 - protein, 23 aa, Canis lupus familiaris
KSLTDSLWTFRTRKSLRSLSLAT

SEQ ID NO: 1823 - protein, 36 aa, Canis lupus familiaris
KSLTQRLPGEWGPSEKKRTQMEKFCGCGVILPRQLL

SEQ ID NO: 1824 - protein, 9 aa, Canis lupus familiaris
KSMETKLII

SEQ ID NO: 1825 - protein, 17 aa, Canis lupus familiaris
KSMKMLIGQTGRHTKKR

SEQ ID NO: 1826 - skipped

SEQ ID NO: 1827 - protein, 16 aa, Canis lupus familiaris
KSMLLRLNLKNMCGPF

SEQ ID NO: 1828-1829 - skipped (2 entries)

SEQ ID NO: 1830 - protein, 11 aa, Canis lupus familiaris
KSMTCSGMKTI

SEQ ID NO: 1831 - protein, 14 aa, Canis lupus familiaris
KSMTCSGMMITLFL

SEQ ID NO: 1832 - protein, 18 aa, Canis lupus familiaris
KSNLRILTLILFFGKKIH

SEQ ID NO: 1833 - protein, 8 aa, Canis lupus familiaris
KSNMRNWN

SEQ ID NO: 1834 - protein, 12 aa, Canis lupus familiaris
KSNTLCSLQRSC

SEQ ID NO: 1835 - protein, 11 aa, Canis lupus familiaris
KSPDPGTGTTN

SEQ ID NO: 1836 - protein, 14 aa, Canis lupus familiaris
KSPDVHISPHLHHG

SEQ ID NO: 1837 - protein, 9 aa, Canis lupus familiaris
KSPFWISCQ

SEQ ID NO: 1838 - protein, 67 aa, Canis lupus familiaris
KSPGIKSSLYSPAQRKEVRRKKRNGQKFLLHLILSIPSMLALMRLRENLLACQNSGLDYYRPPISPN

SEQ ID NO: 1839 - protein, 27 aa, Canis lupus familiaris
KSPLKRNRQVLESSQYYLYDWSSALCS

SEQ ID NO: 1840 - protein, 26 aa, Canis lupus familiaris
KSPLLQERSVSDWMIVHQHIPIGIFH

SEQ ID NO: 1841 - protein, 54 aa, Canis lupus familiaris
KSPLRWWTWVARGLSARSGSSASTESHRSCSWCPPVSTTRCSWRTGAPTGWWSP

SEQ ID NO: 1842 - protein, 22 aa, Canis lupus familiaris
KSPLSSRKSRVSMWPEGSEASL

SEQ ID NO: 1843 - protein, 22 aa, Canis lupus familiaris
KSPPQEREAQGRRAKVWEEASA

SEQ ID NO: 1844 - protein, 10 aa, Canis lupus familiaris
KSPQRFSGQT

SEQ ID NO: 1845 - protein, 45 aa, Canis lupus familiaris
KSPVILKAVVTQIFKRGGTMISLLSAEMVNLLRTFLVRENLLVLT

SEQ ID NO: 1846 - protein, 73 aa, Canis lupus familiaris
KSPWRTWSSSSRPARRTSPARRARRSRPAAPGSASWRATTSWTKITSRTSSTSLRSPAAPTSSPWWWTTEPAS

SEQ ID NO: 1847 - skipped

SEQ ID NO: 1848 - protein, 12 aa, Canis lupus familiaris
KSQALMLDSFMP

SEQ ID NO: 1849 - protein, 41 aa, Canis lupus familiaris
KSQEIRCLFHLPPWIRRSEVFERNLTNSDNRMLVWSHRIIL

SEQ ID NO: 1850 - protein, 16 aa, Canis lupus familiaris
KSQETKMSPLPVIRKS

SEQ ID NO: 1851 - skipped

SEQ ID NO: 1852 - protein, 24 aa, Canis lupus familiaris
KSQGSQNFALAKHHWLILENICAK

SEQ ID NO: 1853 - protein, 21 aa, Canis lupus familiaris
KSQILMSYIFGKQTAFLFASG

SEQ ID NO: 1854 - protein, 13 aa, Canis lupus familiaris
KSQKNSSKFSMTE

SEQ ID NO: 1855 - protein, 11 aa, Canis lupus familiaris
KSQKTVYNGKV

SEQ ID NO: 1856 - protein, 17 aa, Canis lupus familiaris
KSQLLSKKYQQTQKILP

SEQ ID NO: 1857 - protein, 33 aa, Canis lupus familiaris
KSQLPHQPRKQLSPLAKRQQLHQPKRRLHQPKQ

SEQ ID NO: 1858 - protein, 28 aa, Canis lupus familiaris
KSQMIVVDVNLCWSGIATKSMQQRRRQG

SEQ ID NO: 1859 - protein, 27 aa, Canis lupus familiaris
KSQQKFCSRLRNHWPWQVELYQTGVNS

SEQ ID NO: 1860 - skipped

SEQ ID NO: 1861 - protein, 43 aa, Canis lupus familiaris
KSQTKLRRISLPIKMKRKKECGIPLKVSQEGCTKKKTKTKQIF

SEQ ID NO: 1862 - protein, 12 aa, Canis lupus familiaris
KSQTSRILKRES

SEQ ID NO: 1863 - skipped

SEQ ID NO: 1864 - protein, 22 aa, Canis lupus familiaris
KSRASGSKLASIGLSLSMTYSL

SEQ ID NO: 1865 - protein, 29 aa, Canis lupus familiaris
KSRCAEHCPTAVLWRICLRNRLQSMWQRV

SEQ ID NO: 1866 - protein, 19 aa, Canis lupus familiaris
KSRFWESLLISFILSEVRR

SEQ ID NO: 1867 - protein, 27 aa, Canis lupus familiaris
KSRIQYFSVGKFICSNQPVYLSASHGL

SEQ ID NO: 1868 - protein, 16 aa, Canis lupus familiaris
KSRKVVLAIEKKEERS

SEQ ID NO: 1869 - protein, 40 aa, Canis lupus familiaris
KSRLLMLTKSRQRKKKKKRQDQNTKRPRNHFNVFLKIMRK

SEQ ID NO: 1870 - protein, 19 aa, Canis lupus familiaris
KSRNGRTSSESVTRTTRAA

SEQ ID NO: 1871 - skipped

SEQ ID NO: 1872 - protein, 13 aa, Canis lupus familiaris
KSRQEREWNKINM

SEQ ID NO: 1873 - protein, 21 aa, Canis lupus familiaris
KSRRASCLCTRSLLEKSSRRP

SEQ ID NO: 1874 - protein, 16 aa, Canis lupus familiaris
KSRRCIHPHMQCVLRV

SEQ ID NO: 1875 - protein, 16 aa, Canis lupus familiaris
KSRRCIHPHMQCVVRV

SEQ ID NO: 1876 - protein, 37 aa, Canis lupus familiaris
KSRRKEEKKRIVMMSHLTLERRSQRSLSCSRMRLKTF

SEQ ID NO: 1877 - protein, 12 aa, Canis lupus familiaris
KSRRNINSGGFN

SEQ ID NO: 1878 - protein, 14 aa, Canis lupus familiaris
KSRRRTKRTNSCVS

SEQ ID NO: 1879 - protein, 12 aa, Canis lupus familiaris
KSRSETSVRLGY

SEQ ID NO: 1880 - protein, 14 aa, Canis lupus familiaris
KSRSRAFWTKGIGR

SEQ ID NO: 1881 - protein, 8 aa, Canis lupus familiaris
KSRTGCFT

SEQ ID NO: 1882 - protein, 25 aa, Canis lupus familiaris
KSRVQGVADFGQGSQPPRLLILCSP

SEQ ID NO: 1883 - protein, 14 aa, Canis lupus familiaris
KSSCLLLASCLSNL

SEQ ID NO: 1884 - protein, 22 aa, Canis lupus familiaris
KSSERRGFLSYVQILHLTKSRR

SEQ ID NO: 1885 - protein, 83 aa, Canis lupus familiaris
KSSGSPPPSHPRRPPASAQPPAAPPPPQPPPRPCPPHAPTSAPSQGSAATAPHCRSTTSRWATAASSASAWTWTTATCTRASW

SEQ ID NO: 1886 - protein, 8 aa, Canis lupus familiaris
KSSIRHTH

SEQ ID NO: 1887 - protein, 64 aa, Canis lupus familiaris
KSSKDKNQALLRGHLVGGRLSYMLTSPEKQDSNAFFSQEEQRYYLVILYLYLKKLHISFLTSIN

SEQ ID NO: 1888 - protein, 8 aa, Canis lupus familiaris
KSSKSVIQ

SEQ ID NO: 1889 - protein, 9 aa, Canis lupus familiaris
KSSKTIKSL

SEQ ID NO: 1890 - protein, 27 aa, Canis lupus familiaris
KSSLCKKFHRTRIRRLLKNSRKVSHLP

SEQ ID NO: 1891 - protein, 16 aa, Canis lupus familiaris
KSSLGPLIQIHQILLC

SEQ ID NO: 1892 - protein, 14 aa, Canis lupus familiaris
KSSLKEKKKILQGF

SEQ ID NO: 1893 - protein, 22 aa, Canis lupus familiaris
KSSLNLKKNVKTRRILWETVEI

SEQ ID NO: 1894 - skipped

SEQ ID NO: 1895 - protein, 20 aa, Canis lupus familiaris
KSSPLKSVPQSAAPSRHLPQ

SEQ ID NO: 1896 - protein, 25 aa, Canis lupus familiaris
KSSPSLPRRVPLSIPWTPLPQGCRP

SEQ ID NO: 1897 - protein, 17 aa, Canis lupus familiaris
KSSPTNASIALVYTPAT

SEQ ID NO: 1898 - protein, 23 aa, Canis lupus familiaris
KSSQESLQWQTPRNMPVITFVLC

SEQ ID NO: 1899 - protein, 46 aa, Canis lupus familiaris
KSSRMLLFTDLFLSCSHLLSSITGVLYMKLHMYLLTVMWQKILLRL

SEQ ID NO: 1900 - protein, 27 aa, Canis lupus familiaris
KSSSTEKLVKKLEVQKMYLIQKNPLKN

SEQ ID NO: 1901 - protein, 23 aa, Canis lupus familiaris
KSSSVPDFVLHFCGLYRHWSGLL

SEQ ID NO: 1902 - protein, 17 aa, Canis lupus familiaris
KSSTERSCGRTTQMSCQ

SEQ ID NO: 1903 - protein, 35 aa, Canis lupus familiaris
KSSTMLSQKWKRKSLIFKSGTRKIFKNCSRTQTCV

SEQ ID NO: 1904 - protein, 8 aa, Canis lupus familiaris
KSSVGSFI

SEQ ID NO: 1905 - protein, 13 aa, Canis lupus familiaris
KSSVLGQRLEMEK

SEQ ID NO: 1906 - protein, 10 aa, Canis lupus familiaris
KSSWNMNSKN

SEQ ID NO: 1907 - protein, 25 aa, Canis lupus familiaris
KSSYLNILPVLFDVLIVASGLKPKI

SEQ ID NO: 1908 - protein, 9 aa, Canis lupus familiaris
KSTDLDSLF

SEQ ID NO: 1909 - protein, 25 aa, Canis lupus familiaris
KSTFQIISQSANASGNRNCCRSMGY

SEQ ID NO: 1910 - protein, 27 aa, Canis lupus familiaris
KSTGQRLRCSGGVLSLRSLSPMSLETK

SEQ ID NO: 1911 - protein, 14 aa, Canis lupus familiaris
KSTGYQTRFCSPNA

SEQ ID NO: 1912 - protein, 50 aa, Canis lupus familiaris
KSTIGGGSQVLRGVPLHQQAQTTLVSQLKNLKNTLILDHVISVDMSKDIS

SEQ ID NO: 1913 - protein, 34 aa, Canis lupus familiaris
KSTKGKELDMNFRKFQLTSHFLEDGVVISLAKPQ

SEQ ID NO: 1914 - protein, 11 aa, Canis lupus familiaris
KSTKKKRLLAV

SEQ ID NO: 1915 - protein, 12 aa, Canis lupus familiaris
KSTLPLYIQQIW

SEQ ID NO: 1916 - protein, 22 aa, Canis lupus familiaris
KSTPNSMKNLSVIHLEKKWYIA

SEQ ID NO: 1917 - protein, 10 aa, Canis lupus familiaris
KSTRQKQTTL

SEQ ID NO: 1918 - protein, 10 aa, Canis lupus familiaris
KSTRRTLIHL

SEQ ID NO: 1919 - protein, 45 aa, Canis lupus familiaris
KSTSCTCCPLDEFSRRQKNESWRYCVICHLSGWVKPHCESEGLCT

SEQ ID NO: 1920 - protein, 9 aa, Canis lupus familiaris
KSTVVISSW

SEQ ID NO: 1921 - skipped

SEQ ID NO: 1922 - protein, 13 aa, Canis lupus familiaris
KSVFQKAQTWLVY

SEQ ID NO: 1923 - skipped

SEQ ID NO: 1924 - protein, 28 aa, Canis lupus familiaris
KSVGMWLVCCLGHLLWQHFMVSIEKCCP

SEQ ID NO: 1925 - protein, 15 aa, Canis lupus familiaris
KSVNSCLSCPHGRLN

SEQ ID NO: 1926 - protein, 41 aa, Canis lupus familiaris
KSVQTSTWMSNPFLVTRPPPVTVRSQRMTPGRAVWMTASIE

SEQ ID NO: 1927 - protein, 19 aa, Canis lupus familiaris
KSVRMTSVWYPGMWRRQTR

SEQ ID NO: 1928 - protein, 9 aa, Canis lupus familiaris
KSWAFQGTK

SEQ ID NO: 1929 - protein, 25 aa, Canis lupus familiaris
KSWEDLELRPQRRSRNPPPSQGQTR

SEQ ID NO: 1930 - protein, 8 aa, Canis lupus familiaris
KSWFLQGL

SEQ ID NO: 1931 - protein, 55 aa, Canis lupus familiaris
KSWGRTRKPWKRRSRRKSSFLTQPTSGPESTACGSVSARWRGRSPARACCHYPRS

SEQ ID NO: 1932 - protein, 30 aa, Canis lupus familiaris
KSWKILIFKWFQIHSHILIKEVFLRRKVKS

SEQ ID NO: 1933 - protein, 13 aa, Canis lupus familiaris
KSWLNLNVLGVRN

SEQ ID NO: 1934 - protein, 35 aa, Canis lupus familiaris
KSWNRSSRKCVYATLSNSTDCTSSEKSLKTFAIVL

SEQ ID NO: 1935 - protein, 20 aa, Canis lupus familiaris
KSWNRTENGFSGTPASRKEA

SEQ ID NO: 1936 - protein, 26 aa, Canis lupus familiaris
KSWNRTENGFSGTPASRKEKLELSPN

SEQ ID NO: 1937 - protein, 9 aa, Canis lupus familiaris
KSWRMVPSS

SEQ ID NO: 1938 - protein, 26 aa, Canis lupus familiaris
KSWRQKTKKEDEDTKTRFRSHSSYKC

SEQ ID NO: 1939 - protein, 23 aa, Canis lupus familiaris
KSWWKGPKQPSLILTSGGGRTPL

SEQ ID NO: 1940 - protein, 14 aa, Canis lupus familiaris
KSYFREFQDIYFIT

SEQ ID NO: 1941 - protein, 67 aa, Canis lupus familiaris
KSYGVAVICWRLGLRTWRSSRESPTLLSSPSRPGGPQRSSLSPSCLPTGPWGLLLPTLSHILRSMRV

SEQ ID NO: 1942 - skipped

SEQ ID NO: 1943 - protein, 8 aa, Canis lupus familiaris
KSYKKKTL

SEQ ID NO: 1944 - protein, 35 aa, Canis lupus familiaris
KSYKSWKMSIPGSQLVQSLTVKSWSSMVVYQSPQT

SEQ ID NO: 1945 - protein, 21 aa, Canis lupus familiaris
KSYLQPHHLLQTSSLLLPLCL

SEQ ID NO: 1946 - protein, 15 aa, Canis lupus familiaris
KSYMCWRRSSISSKK

SEQ ID NO: 1947 - protein, 21 aa, Canis lupus familiaris
KTAAMHNINFSKLEMKRIPMS

SEQ ID NO: 1948 - protein, 20 aa, Canis lupus familiaris
KTAASSWLWASSYLGPSLWD

SEQ ID NO: 1949 - protein, 25 aa, Canis lupus familiaris
KTAERSIPFFWIITCGTTPVITGKT

SEQ ID NO: 1950 - protein, 48 aa, Canis lupus familiaris
KTAFFASQEIFIVKTIGVCLKAGCVILRMTAVMAAMRRIAQLLCLPES

SEQ ID NO: 1951 - protein, 14 aa, Canis lupus familiaris
KTAIRVSVCLRTFF

SEQ ID NO: 1952 - protein, 8 aa, Canis lupus familiaris
KTAPCRLY

SEQ ID NO: 1953 - skipped

SEQ ID NO: 1954 - protein, 17 aa, Canis lupus familiaris
KTCQKRRNRKEEKRALD

SEQ ID NO: 1955 - protein, 16 aa, Canis lupus familiaris
KTCSLLIIICDQLFLK

SEQ ID NO: 1956 - protein, 8 aa, Canis lupus familiaris
KTCSPSSF

SEQ ID NO: 1957 - protein, 14 aa, Canis lupus familiaris
KTCWSNLTLPTEVI

SEQ ID NO: 1958 - protein, 14 aa, Canis lupus familiaris
KTDIPTSFPMIIPG

SEQ ID NO: 1959 - protein, 10 aa, Canis lupus familiaris
KTEEETEGSC

SEQ ID NO: 1960 - protein, 12 aa, Canis lupus familiaris
KTEKEKRKEEIW

SEQ ID NO: 1961 - protein, 11 aa, Canis lupus familiaris
KTEKLGICPGP

SEQ ID NO: 1962 - protein, 40 aa, Canis lupus familiaris
KTELLLREVGRSRPRRLTNSTRSMSAWSKRTPCCGERLGS

SEQ ID NO: 1963 - protein, 18 aa, Canis lupus familiaris
KTELQQWQTIYKREVLDL

SEQ ID NO: 1964 - protein, 11 aa, Canis lupus familiaris
KTENIPLLRNA

SEQ ID NO: 1965 - protein, 8 aa, Canis lupus familiaris
KTERCWTS

SEQ ID NO: 1966 - protein, 21 aa, Canis lupus familiaris
KTETVQQENIQPPRRCQRSLG

SEQ ID NO: 1967 - protein, 8 aa, Canis lupus familiaris
KTFHIITV

SEQ ID NO: 1968 - protein, 26 aa, Canis lupus familiaris
KTFIVISVDEEKGSSTNSVIFMSVET

SEQ ID NO: 1969 - protein, 20 aa, Canis lupus familiaris
KTFLLTVNGNVSIHPTKNQL

SEQ ID NO: 1970 - protein, 21 aa, Canis lupus familiaris
KTFLNSLIRFLSLNQYGKILV

SEQ ID NO: 1971 - protein, 12 aa, Canis lupus familiaris
KTFMKQNYPNGK

SEQ ID NO: 1972 - protein, 43 aa, Canis lupus familiaris
KTFPNQERCFWKQSKETKKIQSYTSIYLKWNIVVTSNKMKKIS

SEQ ID NO: 1973 - protein, 11 aa, Canis lupus familiaris
KTGDHKETKNL

SEQ ID NO: 1974 - protein, 28 aa, Canis lupus familiaris
KTGERSTQRVVAPNSLPSILMKILPKST

SEQ ID NO: 1975 - protein, 8 aa, Canis lupus familiaris
KTGLCKKL

SEQ ID NO: 1976 - protein, 71 aa, Canis lupus familiaris
KTGLVSCGRISWTGRQIGSCGSPWPARRGSPLLPISFRFDHMSMQKSQISTFTTLWELLPERTATLRSARV

SEQ ID NO: 1977 - skipped

SEQ ID NO: 1978 - protein, 21 aa, Canis lupus familiaris
KTGQLNLPSLHGFQFCHLMPL

SEQ ID NO: 1979 - protein, 29 aa, Canis lupus familiaris
KTHLPKGWISMISRRQAWLLLSPMPTLES

SEQ ID NO: 1980 - protein, 12 aa, Canis lupus familiaris
KTHQSEPTKCAT

SEQ ID NO: 1981 - protein, 18 aa, Canis lupus familiaris
KTHTDVINMRTCLVKNQD

SEQ ID NO: 1982 - protein, 15 aa, Canis lupus familiaris
KTHWKNNPKAIWWAL

SEQ ID NO: 1983 - protein, 9 aa, Canis lupus familiaris
KTICHLSES

SEQ ID NO: 1984 - protein, 37 aa, Canis lupus familiaris
KTIKVKVALSGAISRKKQLKLIFQLQHQEKKPCLTKN

SEQ ID NO: 1985 - protein, 15 aa, Canis lupus familiaris
KTINIRYLEREIDTI

SEQ ID NO: 1986 - protein, 47 aa, Canis lupus familiaris
KTKEVRRFAALKRLDPEEIFTRHFRNRRLSQSPWRAMNQAHRCAPAT

SEQ ID NO: 1987 - skipped

SEQ ID NO: 1988 - protein, 18 aa, Canis lupus familiaris
KTKFCQKHWRLWPPSIMN

SEQ ID NO: 1989 - protein, 13 aa, Canis lupus familiaris
KTKISGKIWDFLK

SEQ ID NO: 1990 - protein, 19 aa, Canis lupus familiaris
KTKKFYYICRVNSVSLKTK

SEQ ID NO: 1991 - protein, 8 aa, Canis lupus familiaris
KTKKKQSV

SEQ ID NO: 1992 - skipped

SEQ ID NO: 1993 - protein, 16 aa, Canis lupus familiaris
KTKQNSAIQFYFQIYK

SEQ ID NO: 1994 - skipped

SEQ ID NO: 1995 - protein, 9 aa, Canis lupus familiaris
KTKRLKTVC

SEQ ID NO: 1996 - protein, 14 aa, Canis lupus familiaris
KTKRLQFSVIPFTI

SEQ ID NO: 1997 - skipped

SEQ ID NO: 1998 - protein, 16 aa, Canis lupus familiaris
KTKTLKLFRKMVNRRK

SEQ ID NO: 1999 - protein, 8 aa, Canis lupus familiaris
KTKTPAKE

SEQ ID NO: 2000 - protein, 10 aa, Canis lupus familiaris
KTKTQLANSL

SEQ ID NO: 2001 - protein, 10 aa, Canis lupus familiaris
KTKWQSNLQM

SEQ ID NO: 2002 - protein, 43 aa, Canis lupus familiaris
KTLCGEDVVQNFSHFLMISPFRNSLRQRQISCFLMQHSVIPTS

SEQ ID NO: 2003 - protein, 12 aa, Canis lupus familiaris
KTLDPKVPVLMC

SEQ ID NO: 2004 - protein, 8 aa, Canis lupus familiaris
KTLGPVKI

SEQ ID NO: 2005 - protein, 11 aa, Canis lupus familiaris
KTLIPIKRIFS

SEQ ID NO: 2006 - protein, 8 aa, Canis lupus familiaris
KTLKCLKK

SEQ ID NO: 2007 - protein, 13 aa, Canis lupus familiaris
KTLKIIYRVWLHD

SEQ ID NO: 2008 - protein, 46 aa, Canis lupus familiaris
KTLKRQMDSFLLVSMKNPHHLFGPASLMVIIKWLSRKRSEFWMGSS

SEQ ID NO: 2009 - protein, 50 aa, Canis lupus familiaris
KTLKRQMDSFLLVSMKNPHHLFGPASLMVIIKWLSRKRSEFWMGSSGLSA

SEQ ID NO: 2010 - protein, 68 aa, Canis lupus familiaris
KTLKRQMDSFLLVSMKNPHHLFGPASLMVIIKWLSRKRYYLLQASSYMMGKGKKDVLPFLLLIKLHSA

SEQ ID NO: 2011 - protein, 9 aa, Canis lupus familiaris
KTLLIKLIL

SEQ ID NO: 2012 - protein, 11 aa, Canis lupus familiaris
KTLLLMFKYNT

SEQ ID NO: 2013 - protein, 12 aa, Canis lupus familiaris
KTLLRKETTLLQ

SEQ ID NO: 2014 - protein, 17 aa, Canis lupus familiaris
KTLMDQSIMVVCSHGYG

SEQ ID NO: 2015 - protein, 13 aa, Canis lupus familiaris
KTLMKKMMKFERL

SEQ ID NO: 2016 - protein, 36 aa, Canis lupus familiaris
KTLSLLFLWASISGPSPLMFLSEGPSMSTKLFSVFF

SEQ ID NO: 2017 - skipped

SEQ ID NO: 2018 - protein, 40 aa, Canis lupus familiaris
KTLYQKLKSCPLKYLIQKWLQKFQKEINLRSQILRKKTTL

SEQ ID NO: 2019 - protein, 27 aa, Canis lupus familiaris
KTMDKRRRWWSRPSAWGAVRTSGTAQP

SEQ ID NO: 2020 - protein, 9 aa, Canis lupus familiaris
KTMISSTDI

SEQ ID NO: 2021 - protein, 9 aa, Canis lupus familiaris
KTMKAVRLC

SEQ ID NO: 2022 - protein, 13 aa, Canis lupus familiaris
KTMQLLTENLQLV

SEQ ID NO: 2023 - protein, 22 aa, Canis lupus familiaris
KTMRNFQRAKTTKRSLSHRSIR

SEQ ID NO: 2024 - protein, 17 aa, Canis lupus familiaris
KTNGKHGYKKTGRTARI

SEQ ID NO: 2025 - protein, 22 aa, Canis lupus familiaris
KTNHIFDMNLLDMTGVGGNTGS

SEQ ID NO: 2026 - protein, 51 aa, Canis lupus familiaris
KTNKIHLILDGMEELGFVRADFQVAPPCLIKTGYLLIQLVANCWREPMEFL

SEQ ID NO: 2027 - protein, 22 aa, Canis lupus familiaris
KTNKSQNQTNRPAYNSLTLTLC

SEQ ID NO: 2028 - protein, 8 aa, Canis lupus familiaris
KTNKTPKT

SEQ ID NO: 2029 - protein, 51 aa, Canis lupus familiaris
KTNQMDFTSEMESVGLTIFLCTENLTHRPKREKCLNEILEQKDYKWRKSPL

SEQ ID NO: 2030 - protein, 43 aa, Canis lupus familiaris
KTNQQTKVKRSQRAMTKEKERKKRRKRLKRNLITQKGVRNYKK

SEQ ID NO: 2031 - skipped

SEQ ID NO: 2032 - protein, 40 aa, Canis lupus familiaris
KTNSFLNTVVSLFLRMRLIDGGRSMTNTCPASSSTSTMIL

SEQ ID NO: 2033-2034 - skipped (2 entries)

SEQ ID NO: 2035 - protein, 8 aa, Canis lupus familiaris
KTPIPTAQ

SEQ ID NO: 2036 - protein, 9 aa, Canis lupus familiaris
KTPKSSSCL

SEQ ID NO: 2037 - protein, 53 aa, Canis lupus familiaris
KTPSFLIPATQWNSWIWPTVLKAKKPYQAWENHQITFLNREQIQKTWRIARIS

SEQ ID NO: 2038 - protein, 35 aa, Canis lupus familiaris
KTPVWPLPVWSIVFYSSVVVFVASNLPAKKISWII

SEQ ID NO: 2039 - protein, 16 aa, Canis lupus familiaris
KTQENLLLTNTSKLTK

SEQ ID NO: 2040 - protein, 13 aa, Canis lupus familiaris
KTQKIWNQILPVW

SEQ ID NO: 2041-2044 - skipped (4 entries)

SEQ ID NO: 2045 - protein, 18 aa, Canis lupus familiaris
KTQTEAPMFLFASKNVKG

SEQ ID NO: 2046 - protein, 38 aa, Canis lupus familiaris
KTRAYKVCTIRYVALKLKLRDKKKCFEIMNPKYFICSE

SEQ ID NO: 2047 - protein, 14 aa, Canis lupus familiaris
KTRDAVSSRKSINS

SEQ ID NO: 2048 - protein, 18 aa, Canis lupus familiaris
KTRHSKKDSRLPTLTQKP

SEQ ID NO: 2049 - protein, 19 aa, Canis lupus familiaris
KTRHSKKTQFLKYKSSRKR

SEQ ID NO: 2050 - protein, 11 aa, Canis lupus familiaris
KTRKAAWDRGW

SEQ ID NO: 2051 - protein, 18 aa, Canis lupus familiaris
KTRKKMRDGKCHRVCSFP

SEQ ID NO: 2052 - protein, 23 aa, Canis lupus familiaris
KTRLKVLNFFLAKELTQTSETAT

SEQ ID NO: 2053 - protein, 41 aa, Canis lupus familiaris
KTRMLKSIGIMIEETSFGKSYAQLNFESYMLWAVSIMTSML

SEQ ID NO: 2054 - protein, 14 aa, Canis lupus familiaris
KTRNMARKAEAPGS

SEQ ID NO: 2055 - protein, 18 aa, Canis lupus familiaris
KTRPLSRCLLLFRQVMIT

SEQ ID NO: 2056 - skipped

SEQ ID NO: 2057 - protein, 61 aa, Canis lupus familiaris
KTRRKQRKKMLPERERRFRLLNDGKRKRWNILERKIKRRENMKEQRSRKRRKQLLRKGKIT

SEQ ID NO: 2058 - protein, 34 aa, Canis lupus familiaris
KTRRMDSSHLSLIIPSLCGWCQLCVSSTRSPARL

SEQ ID NO: 2059 - protein, 13 aa, Canis lupus familiaris
KTRSRRSRRIFST

SEQ ID NO: 2060 - protein, 10 aa, Canis lupus familiaris
KTRTWLPTSS

SEQ ID NO: 2061 - protein, 28 aa, Canis lupus familiaris
KTSCASRVTPPNHQQNPSCLNRAVALSS

SEQ ID NO: 2062 - protein, 9 aa, Canis lupus familiaris
KTSEIVKKK

SEQ ID NO: 2063 - protein, 95 aa, Canis lupus familiaris
KTSHWENRLGFCTRGGVYFGTFTVQLLKGETLVNIRVKQKPFMITVQQPPRALCLATFPPTMGCREAPSLRVSFRVLRGHSPRRTHSLHLTIPAA

SEQ ID NO: 2064 - protein, 59 aa, Canis lupus familiaris
KTSHWGNHQDSYILGGVYFGISTVQLQKDGKHVNIQVKQKPSMIILLCHLGTLEVQGPH

SEQ ID NO: 2065 - protein, 54 aa, Canis lupus familiaris
KTSHWGNHQDSYILGGVYFGISTVQLQKDGKHVNIQVKQKPSMIIVLQQLPAQC

SEQ ID NO: 2066 - protein, 12 aa, Canis lupus familiaris
KTSIVREVLSPA

SEQ ID NO: 2067 - protein, 12 aa, Canis lupus familiaris
KTSKAKKRLKKK

SEQ ID NO: 2068 - protein, 17 aa, Canis lupus familiaris
KTSLGIIWPKSGLMLKA

SEQ ID NO: 2069 - protein, 37 aa, Canis lupus familiaris
KTSLQVSSWGLTQKVLKTATIILIVGQRVTTMQRWKK

SEQ ID NO: 2070 - skipped

SEQ ID NO: 2071 - protein, 18 aa, Canis lupus familiaris
KTTAVILMVMSMVLGATQ

SEQ ID NO: 2072 - protein, 12 aa, Canis lupus familiaris
KTTESTVRSIIL

SEQ ID NO: 2073 - protein, 39 aa, Canis lupus familiaris
KTTGGVIHFQPVMHYVEEMLEGLVEQSYHLVTRNFIQIL

SEQ ID NO: 2074 - protein, 22 aa, Canis lupus familiaris
KTTIKMPQTHKTEDAISEAHGK

SEQ ID NO: 2075 - protein, 28 aa, Canis lupus familiaris
KTTKGITGMSGLSIFSTSYLFSLLRCLT

SEQ ID NO: 2076 - protein, 40 aa, Canis lupus familiaris
KTTKKENMLKCLCEVGQLRCSFLLMLKTMMTSEQNCLLRN

SEQ ID NO: 2077 - protein, 8 aa, Canis lupus familiaris
KTTKLCPA

SEQ ID NO: 2078 - protein, 12 aa, Canis lupus familiaris
KTTKRPPIWNNL

SEQ ID NO: 2079 - protein, 40 aa, Canis lupus familiaris
KTTLLKSCSRISVIFLTPLSLSFHLLSPVFRKSVANTQTC

SEQ ID NO: 2080 - protein, 46 aa, Canis lupus familiaris
KTTMAKNKKFEMTTAPKAERNPMRRRRRKKKMGLGLQRNHSEERKC

SEQ ID NO: 2081 - protein, 22 aa, Canis lupus familiaris
KTTMLALLNPSRGGFCLLYFHL

SEQ ID NO: 2082 - protein, 11 aa, Canis lupus familiaris
KTTNSIAGIPQ

SEQ ID NO: 2083 - protein, 13 aa, Canis lupus familiaris
KTTPSFLLVESEI

SEQ ID NO: 2084 - protein, 44 aa, Canis lupus familiaris
KTTQRFWRINQDLEFQTVIPIPVYSMFRSESPAWKTIQPSLQAP

SEQ ID NO: 2085 - skipped

SEQ ID NO: 2086 - protein, 12 aa, Canis lupus familiaris
KTTSGCCFHCFV

SEQ ID NO: 2087 - protein, 8 aa, Canis lupus familiaris
KTTTYRNK

SEQ ID NO: 2088 - protein, 23 aa, Canis lupus familiaris
KTTVKADSSVSWSSLNTRLQMQK

SEQ ID NO: 2089 - protein, 33 aa, Canis lupus familiaris
KTTVSHHIANQSINFRKNAEKNDRKQQVMAGLA

SEQ ID NO: 2090 - protein, 10 aa, Canis lupus familiaris
KTTWKQNHVY

SEQ ID NO: 2091 - protein, 35 aa, Canis lupus familiaris
KTTWTSAQLPHPWRRRKPSAFPLLHLALLNIPLPP

SEQ ID NO: 2092 - protein, 19 aa, Canis lupus familiaris
KTVLLNQHFHCLLVMNRNL

SEQ ID NO: 2093 - protein, 9 aa, Canis lupus familiaris
KTVMTWRLF

SEQ ID NO: 2094 - protein, 11 aa, Canis lupus familiaris
KTVNFLWRSNK

SEQ ID NO: 2095 - protein, 41 aa, Canis lupus familiaris
KTVRNTEMDTEWHLRVHFVNSEHLKKKILNYIWKVLHTKKH

SEQ ID NO: 2096 - protein, 14 aa, Canis lupus familiaris
KTVSSVPGPGSQRA

SEQ ID NO: 2097 - protein, 10 aa, Canis lupus familiaris
KTVYWKTSKD

SEQ ID NO: 2098 - protein, 39 aa, Canis lupus familiaris
KTWELWVPLPWTAKETWPMQPRRVASLIRWLAVLGTPHA

SEQ ID NO: 2099 - protein, 38 aa, Canis lupus familiaris
KTWMSVSVNHAKMELPVKMVPIASGANVQQASQGHIVK

SEQ ID NO: 2100 - protein, 14 aa, Canis lupus familiaris
KTWPPQKNTPSQVK

SEQ ID NO: 2101 - protein, 16 aa, Canis lupus familiaris
KTWRKLTPRLVCSWIT

SEQ ID NO: 2102 - protein, 9 aa, Canis lupus familiaris
KTWSDRWSQ

SEQ ID NO: 2103 - protein, 34 aa, Canis lupus familiaris
KTYLTERLIQISQNILLKSCSIKVIIKKNFNCKY

SEQ ID NO: 2104 - protein, 20 aa, Canis lupus familiaris
KVARRRVLLSRQCQPFSGRI

SEQ ID NO: 2105 - protein, 29 aa, Canis lupus familiaris
KVASLGHSYCLDPETRLLRCGTSVLACAL

SEQ ID NO: 2106 - protein, 11 aa, Canis lupus familiaris
KVAVVKDGGKC

SEQ ID NO: 2107 - protein, 40 aa, Canis lupus familiaris
KVDLHHLLMSWQLESKGKLQARWKRSEQPCPQEKQNLGRH

SEQ ID NO: 2108 - protein, 10 aa, Canis lupus familiaris
KVDRYFQSEL

SEQ ID NO: 2109-2110 - skipped (2 entries)

SEQ ID NO: 2111 - protein, 21 aa, Canis lupus familiaris
KVEYLEKNWKRRFILFRESLS

SEQ ID NO: 2112 - protein, 8 aa, Canis lupus familiaris
KVFISSFL

SEQ ID NO: 2113 - protein, 22 aa, Canis lupus familiaris
KVFSRRHRHGWYIRLLFPAMLH

SEQ ID NO: 2114 - protein, 73 aa, Canis lupus familiaris
KVGKKNKTFQNVKKPFVKDLGSHQELRVQLQRLILHLMVQILDGRQKSKHGWIDMKRQIVTNIVRVFRGRHKE

SEQ ID NO: 2115 - protein, 70 aa, Canis lupus familiaris
KVGLIGSPMESLGHTARHECLKETLRMVLIWISQVTESMTFVTLLPGHPGRAASSLNTREITSSCIATRT

SEQ ID NO: 2116 - protein, 22 aa, Canis lupus familiaris
KVGNRALERDLWSMACYQEDLL

SEQ ID NO: 2117 - protein, 21 aa, Canis lupus familiaris
KVGRPFIMDSDLLNSTVFLLV

SEQ ID NO: 2118 - protein, 27 aa, Canis lupus familiaris
KVGTGAPESVCMRPSAIQQTAHLQRSL

SEQ ID NO: 2119 - protein, 22 aa, Canis lupus familiaris
KVHFFGKMKMIELISLEQRTIR

SEQ ID NO: 2120 - protein, 14 aa, Canis lupus familiaris
KVHQHQVLCFHGDG

SEQ ID NO: 2121 - protein, 13 aa, Canis lupus familiaris
KVIFQKQCFTCPT

SEQ ID NO: 2122 - protein, 14 aa, Canis lupus familiaris
KVIKQEQDQRIVKH

SEQ ID NO: 2123 - skipped

SEQ ID NO: 2124 - protein, 35 aa, Canis lupus familiaris
KVITIEISEGSVLGLTSEQVIATSGITLVTAGIGG

SEQ ID NO: 2125 - protein, 35 aa, Canis lupus familiaris
KVIYSHTIFYKLQVYCFHYVFEKDRIFPQHPDFLH

SEQ ID NO: 2126 - protein, 40 aa, Canis lupus familiaris
KVIYSHTIFYKLQVYCFHYVFEKDRIFPQHPELDHSCGAS

SEQ ID NO: 2127 - protein, 35 aa, Canis lupus familiaris
KVIYSHTIFYKLQVYCFHYVFEKDRIFPQHPENFL

SEQ ID NO: 2128 - protein, 21 aa, Canis lupus familiaris
KVKEADHLNLLVEVHQRKSQQ

SEQ ID NO: 2129 - protein, 16 aa, Canis lupus familiaris
KVKEELRKWKQKAWKV

SEQ ID NO: 2130 - protein, 29 aa, Canis lupus familiaris
KVKIERLKVNLVNQTIHEKLTVGFFLLTF

SEQ ID NO: 2131 - protein, 41 aa, Canis lupus familiaris
KVKILGISSHFLHTLRSQKMIQLNLIAMKKILPLFFHRHLV

SEQ ID NO: 2132 - protein, 18 aa, Canis lupus familiaris
KVKKINLKINHIHKKIWY

SEQ ID NO: 2133 - skipped

SEQ ID NO: 2134 - protein, 47 aa, Canis lupus familiaris
KVKKMRRKKRNQLSARLQCFAIQIGLIGCICWWGQWLPSSMELHSLS

SEQ ID NO: 2135 - skipped

SEQ ID NO: 2136 - protein, 15 aa, Canis lupus familiaris
KVKNTIFFSWKIYMQ

SEQ ID NO: 2137 - protein, 12 aa, Canis lupus familiaris
KVKPILLEEGTS

SEQ ID NO: 2138 - protein, 14 aa, Canis lupus familiaris
KVKSSERKTHSRID

SEQ ID NO: 2139 - protein, 10 aa, Canis lupus familiaris
KVKYPRGDQI

SEQ ID NO: 2140 - protein, 41 aa, Canis lupus familiaris
KVLCPNYLLQKNVCHGALDGVLPVTVVDLALAVKNYWMSMC

SEQ ID NO: 2141 - protein, 36 aa, Canis lupus familiaris
KVLEKMESSVLVWTTLAHCSGAFRRKKLFCLPMEIV

SEQ ID NO: 2142 - protein, 36 aa, Canis lupus familiaris
KVLGKICSKGRDLIFLTLRQLLKRHLKQRLHLHSGI

SEQ ID NO: 2143 - skipped

SEQ ID NO: 2144 - protein, 28 aa, Canis lupus familiaris
KVLIQVSKLMMKIRMNGICLLERGGKLE

SEQ ID NO: 2145 - protein, 13 aa, Canis lupus familiaris
KVLNLCSRHFSKL

SEQ ID NO: 2146 - protein, 15 aa, Canis lupus familiaris
KVLQTHFGHSEQENH

SEQ ID NO: 2147 - protein, 13 aa, Canis lupus familiaris
KVLSKSSLIFVKN

SEQ ID NO: 2148 - protein, 37 aa, Canis lupus familiaris
KVLTLALITLRTLNLKNTPWNQTVPTPQSQGKLKAAP

SEQ ID NO: 2149 - protein, 11 aa, Canis lupus familiaris
KVNFLKEMLTH

SEQ ID NO: 2150 - protein, 8 aa, Canis lupus familiaris
KVNKSRCI

SEQ ID NO: 2151 - protein, 9 aa, Canis lupus familiaris
KVNNFFIKL

SEQ ID NO: 2152 - protein, 43 aa, Canis lupus familiaris
KVPAALAPPILDQKVQLLDHYLELLLKFQKLNILILLTTTSLS

SEQ ID NO: 2153 - protein, 15 aa, Canis lupus familiaris
KVPALKKLQSPLLIF

SEQ ID NO: 2154 - protein, 52 aa, Canis lupus familiaris
KVPGPQAKEWKDLQELDPEQLSPLPLPSYAGPGGQGRMQISAASCCRSPWMP

SEQ ID NO: 2155 - protein, 37 aa, Canis lupus familiaris
KVPNQAKFGLWLIIKLKTSVLGVLVETLQLWTLPGSL

SEQ ID NO: 2156 - protein, 17 aa, Canis lupus familiaris
KVPRPSEKKEAHLEGQQ

SEQ ID NO: 2157 - protein, 37 aa, Canis lupus familiaris
KVQKRNPKIVNSPLNQVTAVLLIFWLIRKRMLEIPKP

SEQ ID NO: 2158 - protein, 8 aa, Canis lupus familiaris
KVQVQVSV

SEQ ID NO: 2159 - protein, 34 aa, Canis lupus familiaris
KVRATARKSLFTDRQFTNSLCEGHSQSTTRNQKI

SEQ ID NO: 2160 - protein, 27 aa, Canis lupus familiaris
KVRCFLLIKLENPIRLKLNRLSLISIS

SEQ ID NO: 2161 - protein, 11 aa, Canis lupus familiaris
KVRGYRRKETS

SEQ ID NO: 2162 - protein, 10 aa, Canis lupus familiaris
KVRKILQSSL

SEQ ID NO: 2163 - protein, 8 aa, Canis lupus familiaris
KVRVTLTW

SEQ ID NO: 2164 - protein, 27 aa, Canis lupus familiaris
KVSAAYCHLSKLQFFNKSVMILQRNLN

SEQ ID NO: 2165 - protein, 27 aa, Canis lupus familiaris
KVSAIVGLASLCINCDEWTLRAGQSSG

SEQ ID NO: 2166 - protein, 11 aa, Canis lupus familiaris
KVSCKITFLSY

SEQ ID NO: 2167 - protein, 23 aa, Canis lupus familiaris
KVSCRPGDWSSELIFWKMPIQMS

SEQ ID NO: 2168 - protein, 10 aa, Canis lupus familiaris
KVSISSRIHG

SEQ ID NO: 2169 - protein, 8 aa, Canis lupus familiaris
KVSLNLVI

SEQ ID NO: 2170 - protein, 100 aa, Canis lupus familiaris
KVSLSPPLSNKKHLRQKPTQNEPSPDLAKRGCWAAGSLSGSAATTSGAAASEAEVRSPQGGCLWAGRGRLPRLGAGPGWRQRRPGPGPGRPRRSSSRRRC

SEQ ID NO: 2171 - protein, 17 aa, Canis lupus familiaris
KVSLYYPEAEVFRSSMC

SEQ ID NO: 2172 - protein, 9 aa, Canis lupus familiaris
KVSNYNTKH

SEQ ID NO: 2173 - protein, 10 aa, Canis lupus familiaris
KVSQLGHVFP

SEQ ID NO: 2174 - protein, 11 aa, Canis lupus familiaris
KVSWRGLHTKS

SEQ ID NO: 2175 - protein, 25 aa, Canis lupus familiaris
KVTASGNQCSGHGSPGQRFPRYQRT

SEQ ID NO: 2176 - protein, 8 aa, Canis lupus familiaris
KVTDEHSF

SEQ ID NO: 2177 - protein, 8 aa, Canis lupus familiaris
KVTFCLRT

SEQ ID NO: 2178 - protein, 9 aa, Canis lupus familiaris
KVTGLVAAQ

SEQ ID NO: 2179 - protein, 13 aa, Canis lupus familiaris
KVTGQKGTSLHPL

SEQ ID NO: 2180 - protein, 9 aa, Canis lupus familiaris
KVTKHSQSK

SEQ ID NO: 2181 - protein, 26 aa, Canis lupus familiaris
KVTPPPQVTSPGMVRLWRPGMALMNT

SEQ ID NO: 2182 - protein, 18 aa, Canis lupus familiaris
KVTRSRNWNNKLKNYRQN

SEQ ID NO: 2183 - protein, 9 aa, Canis lupus familiaris
KVTSMEMIL

SEQ ID NO: 2184 - protein, 74 aa, Canis lupus familiaris
KVTVAGNLSPKSLKKALGISQRRAISCQLFVDLENRALVNNHSPLKEPSTVWKETGAQIPAAMEGLKSPVPEPG

SEQ ID NO: 2185 - protein, 11 aa, Canis lupus familiaris
KVVEAENQKGR

SEQ ID NO: 2186 - protein, 16 aa, Canis lupus familiaris
KVVFRKFFFHYFFYFG

SEQ ID NO: 2187 - protein, 12 aa, Canis lupus familiaris
KVVQLTGLSQIK

SEQ ID NO: 2188 - protein, 17 aa, Canis lupus familiaris
KVVWLQMRETRLFKCRY

SEQ ID NO: 2189 - protein, 52 aa, Canis lupus familiaris
KVWNSNFQTVYSLRRRELPRLQGSLKCLWMENWSIQRRKVMVLWMRPGCRRL

SEQ ID NO: 2190 - protein, 29 aa, Canis lupus familiaris
KVWPVKRIIQTLTKRRKKKRVLQKEKTMN

SEQ ID NO: 2191 - protein, 12 aa, Canis lupus familiaris
KVWTQVECVGFI

SEQ ID NO: 2192 - protein, 11 aa, Canis lupus familiaris
KVYLMYMLPSG

SEQ ID NO: 2193 - protein, 31 aa, Canis lupus familiaris
KWARSLPVKRRRRLISAKSRFKGQKRNSTHW

SEQ ID NO: 2194 - protein, 51 aa, Canis lupus familiaris
KWCEMICFITITPMCQKRSKRQMWRLRSQVNSLRHLMISFLKRNPLDTEEP

SEQ ID NO: 2195 - protein, 33 aa, Canis lupus familiaris
KWCEMICFITITPMCQKRSKRQMWRNPLDTEEP

SEQ ID NO: 2196 - protein, 23 aa, Canis lupus familiaris
KWDQRKRKMGKVISNGNDLSKTD

SEQ ID NO: 2197 - protein, 18 aa, Canis lupus familiaris
KWDVRLMDYKRSYQKQKK

SEQ ID NO: 2198 - protein, 30 aa, Canis lupus familiaris
KWETGHWRETCGPWPATRRICYEEWSDINW

SEQ ID NO: 2199 - protein, 17 aa, Canis lupus familiaris
KWFSRKPAPSLAQVTVI

SEQ ID NO: 2200 - protein, 14 aa, Canis lupus familiaris
KWFSSITVPRDDKG

SEQ ID NO: 2201 - protein, 8 aa, Canis lupus familiaris
KWGKMKLS

SEQ ID NO: 2202 - protein, 11 aa, Canis lupus familiaris
KWGKRTKHFKM

SEQ ID NO: 2203 - protein, 34 aa, Canis lupus familiaris
KWKDSCCLQEISRRTGSHKHVPRLPIQRVESGRP

SEQ ID NO: 2204 - skipped

SEQ ID NO: 2205 - protein, 12 aa, Canis lupus familiaris
KWKIFKSWGIIH

SEQ ID NO: 2206 - protein, 8 aa, Canis lupus familiaris
KWKKMKRS

SEQ ID NO: 2207 - skipped

SEQ ID NO: 2208 - protein, 10 aa, Canis lupus familiaris
KWKRIHHAAH

SEQ ID NO: 2209 - protein, 11 aa, Canis lupus familiaris
KWKVKIRSRYW

SEQ ID NO: 2210 - protein, 18 aa, Canis lupus familiaris
KWKVLQLQKENLLWKLKG

SEQ ID NO: 2211 - protein, 53 aa, Canis lupus familiaris
KWLLLCLEKYHPQQWKKLCKISLRLKNYTLVFLSPITCTWPSVTLILNKQITL

SEQ ID NO: 2212 - protein, 14 aa, Canis lupus familiaris
KWLRRKYLEFTSYL

SEQ ID NO: 2213 - protein, 18 aa, Canis lupus familiaris
KWLTIYKKCKKMALKEKI

SEQ ID NO: 2214 - protein, 11 aa, Canis lupus familiaris
KWMADAWKKWY

SEQ ID NO: 2215 - protein, 11 aa, Canis lupus familiaris
KWMIYLQNQRF

SEQ ID NO: 2216-2217 - skipped (2 entries)

SEQ ID NO: 2218 - protein, 16 aa, Canis lupus familiaris
KWNSYSYCQKLSFQDT

SEQ ID NO: 2219 - protein, 19 aa, Canis lupus familiaris
KWNTWKRIGREDSFSSERA

SEQ ID NO: 2220 - protein, 17 aa, Canis lupus familiaris
KWQAWAILTVWIQRQDY

SEQ ID NO: 2221 - protein, 52 aa, Canis lupus familiaris
KWQLQLRQLLLMRHLLWLTYHQVIKGWSTRLFTPLYAIFCGNIDLKTPFTRT

SEQ ID NO: 2222 - protein, 20 aa, Canis lupus familiaris
KWQNTNYSKGRNQVLSHKYM

SEQ ID NO: 2223 - skipped

SEQ ID NO: 2224 - protein, 24 aa, Canis lupus familiaris
KWRMHAHEVPTAPVPAGVVLDLQL

SEQ ID NO: 2225 - protein, 12 aa, Canis lupus familiaris
KWRPFLLRESRQ

SEQ ID NO: 2226 - protein, 20 aa, Canis lupus familiaris
KWRRQYLTSRISHFQKPHHI

SEQ ID NO: 2227 - protein, 11 aa, Canis lupus familiaris
KWRWHSEISTS

SEQ ID NO: 2228 - protein, 9 aa, Canis lupus familiaris
KWSGYCILV

SEQ ID NO: 2229 - skipped

SEQ ID NO: 2230 - protein, 13 aa, Canis lupus familiaris
KWSVGWNSSSECL

SEQ ID NO: 2231 - protein, 8 aa, Canis lupus familiaris
KWTKTKRL

SEQ ID NO: 2232 - protein, 10 aa, Canis lupus familiaris
KWTLMKTFQG

SEQ ID NO: 2233 - protein, 18 aa, Canis lupus familiaris
KWTMTMMGSCLSQTMNRL

SEQ ID NO: 2234 - protein, 19 aa, Canis lupus familiaris
KWVYGPQLCIVRPTGIPCM

SEQ ID NO: 2235 - protein, 10 aa, Canis lupus familiaris
KWWCCYYSFL

SEQ ID NO: 2236 - protein, 8 aa, Canis lupus familiaris
KWWLQPAL

SEQ ID NO: 2237 - protein, 14 aa, Canis lupus familiaris
KYAASAANVSVFTF

SEQ ID NO: 2238 - protein, 25 aa, Canis lupus familiaris
KYAQLQHRSRCIYLLSEYTSWWPGH

SEQ ID NO: 2239 - protein, 12 aa, Canis lupus familiaris
KYDSTLSPTYFA

SEQ ID NO: 2240 - protein, 52 aa, Canis lupus familiaris
KYESNFELSMKRQYSSVVKKNPLIFQEKKRSGERKIYKYNCILKELSLPLPQ

SEQ ID NO: 2241 - protein, 10 aa, Canis lupus familiaris
KYFHYRRFEK

SEQ ID NO: 2242 - protein, 11 aa, Canis lupus familiaris
KYFLQKFLDSK

SEQ ID NO: 2243 - protein, 26 aa, Canis lupus familiaris
KYFSIQKNVDSAVWICFGSWMCSSYH

SEQ ID NO: 2244 - protein, 8 aa, Canis lupus familiaris
KYFYLILS

SEQ ID NO: 2245 - protein, 33 aa, Canis lupus familiaris
KYGDSKLVRLSWKSLQCCITSLRICFWLVKEIL

SEQ ID NO: 2246 - protein, 9 aa, Canis lupus familiaris
KYGIKIIFL

SEQ ID NO: 2247 - protein, 8 aa, Canis lupus familiaris
KYGKIESY

SEQ ID NO: 2248 - skipped

SEQ ID NO: 2249 - protein, 25 aa, Canis lupus familiaris
KYHCLFQWESAWWKQPGNSCSGDNL

SEQ ID NO: 2250 - protein, 8 aa, Canis lupus familiaris
KYHFRTTF

SEQ ID NO: 2251 - protein, 19 aa, Canis lupus familiaris
KYHIQQSQKDSCFLPRNKI

SEQ ID NO: 2252 - protein, 8 aa, Canis lupus familiaris
KYINLRCP

SEQ ID NO: 2253 - protein, 60 aa, Canis lupus familiaris
KYIQVRRPISVKNVENVLVVGIISLFITKVYTWEKKCGKNTKQPFINVMFVRKFLKANQV

SEQ ID NO: 2254 - protein, 9 aa, Canis lupus familiaris
KYKEEKSEK

SEQ ID NO: 2255 - protein, 28 aa, Canis lupus familiaris
KYKHHTKPSGKRLTQYLLHKLSNLARQK

SEQ ID NO: 2256 - protein, 22 aa, Canis lupus familiaris
KYKMMLVFEFSLSQMMEQHLIE

SEQ ID NO: 2257 - protein, 10 aa, Canis lupus familiaris
KYKPPPRLDS

SEQ ID NO: 2258 - protein, 53 aa, Canis lupus familiaris
KYKTTLKSYFMCQKTLQILMKSILTWFTNVAYTKIVMELPALGVTISSGLILP

SEQ ID NO: 2259 - protein, 16 aa, Canis lupus familiaris
KYLKKSWKKKLIKRLN

SEQ ID NO: 2260 - protein, 12 aa, Canis lupus familiaris
KYLLTAQSWRCL

SEQ ID NO: 2261 - protein, 8 aa, Canis lupus familiaris
KYLQKNGR

SEQ ID NO: 2262 - protein, 14 aa, Canis lupus familiaris
KYLVTLGWNTVKNT

SEQ ID NO: 2263 - protein, 14 aa, Canis lupus familiaris
KYLVVLHYCLRRTK

SEQ ID NO: 2264 - protein, 10 aa, Canis lupus familiaris
KYPRRGSNNW

SEQ ID NO: 2265 - protein, 12 aa, Canis lupus familiaris
KYPTNTSPNESC

SEQ ID NO: 2266 - protein, 12 aa, Canis lupus familiaris
KYPVLTTLQFQG

SEQ ID NO: 2267 - protein, 35 aa, Canis lupus familiaris
KYQILHILLRKWISLLETMNVKRKLISACQFLAAA

SEQ ID NO: 2268 - protein, 38 aa, Canis lupus familiaris
KYQILHILLRKWISLLETMNVKRKLISVGIILMMKLMK

SEQ ID NO: 2269 - skipped

SEQ ID NO: 2270 - protein, 48 aa, Canis lupus familiaris
KYREHRREWEILLVNESNSAMTEYARVTFSTVAPMMSSLELEWILENV

SEQ ID NO: 2271 - protein, 9 aa, Canis lupus familiaris
KYRGKKRAP

SEQ ID NO: 2272 - protein, 11 aa, Canis lupus familiaris
KYRKIEIIMPQ

SEQ ID NO: 2273 - protein, 27 aa, Canis lupus familiaris
KYRKMPEIFLYLKNPKTERRKRKRMIP

SEQ ID NO: 2274 - protein, 13 aa, Canis lupus familiaris
KYRQILCFAVFYN

SEQ ID NO: 2275 - protein, 8 aa, Canis lupus familiaris
KYRRKFRQ

SEQ ID NO: 2276 - protein, 8 aa, Canis lupus familiaris
KYTIQNHC

SEQ ID NO: 2277 - protein, 12 aa, Canis lupus familiaris
KYTKTTLWNTKK

SEQ ID NO: 2278 - protein, 11 aa, Canis lupus familiaris
KYTSWLRIPCP

SEQ ID NO: 2279 - protein, 34 aa, Canis lupus familiaris
KYVFWWNFATVSPTSVCSGSKELFRVSTAFTAES

SEQ ID NO: 2280 - protein, 20 aa, Canis lupus familiaris
KYVLMAQDIPPMEEILMNVR

SEQ ID NO: 2281 - protein, 32 aa, Canis lupus familiaris
KYVPMLFFSTLMNPLNVLNLEACYPSRSRGPL

SEQ ID NO: 2282 - protein, 41 aa, Canis lupus familiaris
KYVQDQQKQIMRDLIIYVKMLLLRRNVDTQATARSLIAKKR

SEQ ID NO: 2283 - protein, 14 aa, Canis lupus familiaris
KYWRKWRSQMPTTF

SEQ ID NO: 2284 - protein, 44 aa, Canis lupus familiaris
KYWYNKESKAAKLRKFFGFSHIAQVGGVLHFSGRVTAVSRRESV

SEQ ID NO: 2285 - protein, 23 aa, Canis lupus familiaris
MAASSSSKDGTTSFTSEILRRKK

SEQ ID NO: 2286 - protein, 23 aa, Canis lupus familiaris
MAVCSALCHLFCTKPHVFLGPNR

SEQ ID NO: 2287 - protein, 9 aa, Canis lupus familiaris
MEGYDSGIH

SEQ ID NO: 2288 - protein, 10 aa, Canis lupus familiaris
MFRCCSAGRF

SEQ ID NO: 2289 - protein, 35 aa, Canis lupus familiaris
MGREVRSTNQHSNKRSRRICWAPCKCIQINETSEH

SEQ ID NO: 2290 - protein, 11 aa, Canis lupus familiaris
MGYQRRKKCYN

SEQ ID NO: 2291 - protein, 14 aa, Canis lupus familiaris
MLAQIWILQENLQS

SEQ ID NO: 2292 - protein, 11 aa, Canis lupus familiaris
MLGSCAIWWKW

SEQ ID NO: 2293 - protein, 47 aa, Canis lupus familiaris
MLQIPSEYEKSRWPHCLLYKESLPPRMYPGYQGKQGRCCDPGWWFGV

SEQ ID NO: 2294 - protein, 30 aa, Canis lupus familiaris
MLRGLEARAICLILQGWTVEVHRFGSPFAQ

SEQ ID NO: 2295 - protein, 8 aa, Canis lupus familiaris
MVYAHVNY

SEQ ID NO: 2296 - protein, 15 aa, Canis lupus familiaris
MYGKDRHSGQNNVEN

SEQ ID NO: 2297 - protein, 35 aa, Canis lupus familiaris
NAAANGLKMSSHRRCPQKKSSGTEACGTHPAPRPS

SEQ ID NO: 2298 - protein, 57 aa, Canis lupus familiaris
NAANLPGKPSCYSNKNHWRAPNTTMALPSVPSPTLDRCPASPLTTTPSLPGYHLSLI

SEQ ID NO: 2299 - protein, 14 aa, Canis lupus familiaris
NADCLTRTCNKSNC

SEQ ID NO: 2300 - protein, 26 aa, Canis lupus familiaris
NADPQKEENQTEPLQGHEQFQVREGA

SEQ ID NO: 2301 - protein, 8 aa, Canis lupus familiaris
NAEASLYL

SEQ ID NO: 2302 - protein, 28 aa, Canis lupus familiaris
NAEDGTAVSERGRRGSIPPRRLSHILGR

SEQ ID NO: 2303 - protein, 8 aa, Canis lupus familiaris
NAERTRNI

SEQ ID NO: 2304 - protein, 8 aa, Canis lupus familiaris
NAFKTIEE

SEQ ID NO: 2305 - protein, 30 aa, Canis lupus familiaris
NAGLLRYLVEMVRQDLSKILLTQYSAFQLH

SEQ ID NO: 2306 - protein, 17 aa, Canis lupus familiaris
NAGTNLDTAGKPAKLTK

SEQ ID NO: 2307 - protein, 73 aa, Canis lupus familiaris
NAIGVMSVGRVSVRAQTCKLIRESTQGRSPIRALSVVRALTRPHIFMLICLFTQERNPTDVKVVGRASVVAQI

SEQ ID NO: 2308 - protein, 10 aa, Canis lupus familiaris
NAKFRIKTRV

SEQ ID NO: 2309 - protein, 13 aa, Canis lupus familiaris
NAKLHHLLSVLLS

SEQ ID NO: 2310 - protein, 11 aa, Canis lupus familiaris
NAKLVSILVRR

SEQ ID NO: 2311 - protein, 27 aa, Canis lupus familiaris
NALAQVHYLFSRHLVTICTTSSNYPFT

SEQ ID NO: 2312 - protein, 56 aa, Canis lupus familiaris
NALCGPRPCKESSEICSASLAKGVPTQVCEEVDGAVVRAQVQHGLATFREGDPQNE

SEQ ID NO: 2313 - protein, 13 aa, Canis lupus familiaris
NALNVKWLRVKLQ

SEQ ID NO: 2314 - protein, 23 aa, Canis lupus familiaris
NAPGEEKETEQESDLLGWRCCQD

SEQ ID NO: 2315 - protein, 19 aa, Canis lupus familiaris
NAQRTGSSCDLPHSPGMDS

SEQ ID NO: 2316 - protein, 8 aa, Canis lupus familiaris
NARGKLTS

SEQ ID NO: 2317 - protein, 9 aa, Canis lupus familiaris
NASQERKEI

SEQ ID NO: 2318 - skipped

SEQ ID NO: 2319 - protein, 17 aa, Canis lupus familiaris
NASRFIPSCNTYHKKQN

SEQ ID NO: 2320 - protein, 11 aa, Canis lupus familiaris
NASVNARICSD

SEQ ID NO: 2321 - skipped

SEQ ID NO: 2322 - protein, 9 aa, Canis lupus familiaris
NAVEKDGST

SEQ ID NO: 2323 - protein, 24 aa, Canis lupus familiaris
NAVGSLQEARNECCYKQYQRNYFL

SEQ ID NO: 2324 - protein, 8 aa, Canis lupus familiaris
NAVLTTLK

SEQ ID NO: 2325 - protein, 25 aa, Canis lupus familiaris
NCAEQNNHGESGRQAGKQLPGGARR

SEQ ID NO: 2326 - skipped

SEQ ID NO: 2327 - protein, 44 aa, Canis lupus familiaris
NCFASYLKMSLILWRRNLSLFYHRISFGSMENTVYLRSAQLILS

SEQ ID NO: 2328 - protein, 12 aa, Canis lupus familiaris
NCFNKPTVSDLF

SEQ ID NO: 2329 - protein, 15 aa, Canis lupus familiaris
NCHRGKNLPASWMPH

SEQ ID NO: 2330 - protein, 46 aa, Canis lupus familiaris
NCIVRLNALFESLRLIFHIICLRIKPFMISSNVNPDPLARGMPWHY

SEQ ID NO: 2331 - protein, 8 aa, Canis lupus familiaris
NCIYLTQI

SEQ ID NO: 2332 - protein, 9 aa, Canis lupus familiaris
NCKRQWTRS

SEQ ID NO: 2333 - protein, 28 aa, Canis lupus familiaris
NCLADFRSEESHWKRGGCCKSFLFYSVL

SEQ ID NO: 2334 - protein, 16 aa, Canis lupus familiaris
NCLEQSNFASSYSKKR

SEQ ID NO: 2335 - skipped

SEQ ID NO: 2336 - protein, 15 aa, Canis lupus familiaris
NCLQLQYHLLPPRSL

SEQ ID NO: 2337 - protein, 21 aa, Canis lupus familiaris
NCLSLKRSRFTLGIHVQQFMM

SEQ ID NO: 2338 - protein, 17 aa, Canis lupus familiaris
NCNSKLPTDPSKSQDCI

SEQ ID NO: 2339 - protein, 8 aa, Canis lupus familiaris
NCPGAAFN

SEQ ID NO: 2340 - protein, 9 aa, Canis lupus familiaris
NCPREDIKF

SEQ ID NO: 2341 - protein, 9 aa, Canis lupus familiaris
NCQPLGGGS

SEQ ID NO: 2342 - protein, 10 aa, Canis lupus familiaris
NCRASNSRAS

SEQ ID NO: 2343 - protein, 33 aa, Canis lupus familiaris
NCRKWFLPSKLRWTSICGIKVQSSHHLIFLKEK

SEQ ID NO: 2344 - protein, 32 aa, Canis lupus familiaris
NCRQTIQAQGLYAKSSEISVACSRPRAMDRRL

SEQ ID NO: 2345 - protein, 69 aa, Canis lupus familiaris
NCSAPKCHHHLVPFIILMWNQKFLLMPLLYLRSSMTISEQRYSTTENLIKVLFFIYVPHLECALRKFEP

SEQ ID NO: 2346 - protein, 17 aa, Canis lupus familiaris
NCSQQEIYELRSFLRGF

SEQ ID NO: 2347 - skipped

SEQ ID NO: 2348 - protein, 74 aa, Canis lupus familiaris
NCVLFRVSTAETLKGVSLRHSILQLAIIGYLWWSICCNMELTCMLKIKEALYLCTMLVLTDIMKLQNFLLSMEQ

SEQ ID NO: 2349 - protein, 14 aa, Canis lupus familiaris
NCYARNQVTKATEA

SEQ ID NO: 2350 - protein, 26 aa, Canis lupus familiaris
NDDRHSRKRENDDQQQDANREEGTLG

SEQ ID NO: 2351 - protein, 19 aa, Canis lupus familiaris
NDELGAMATSNRGRHVLLT

SEQ ID NO: 2352 - protein, 21 aa, Canis lupus familiaris
NDGLSPCPRPLLRKSVKTSMQ

SEQ ID NO: 2353 - protein, 20 aa, Canis lupus familiaris
NDKRSFDRRENFSPKKSSLL

SEQ ID NO: 2354 - protein, 24 aa, Canis lupus familiaris
NDRAGKSPAKSQVHVSLRAAPRPS

SEQ ID NO: 2355 - skipped

SEQ ID NO: 2356 - protein, 23 aa, Canis lupus familiaris
NDVGHEDFHLRHHCVYWIWSSGC

SEQ ID NO: 2357 - protein, 40 aa, Canis lupus familiaris
NDWNSHEAPPQEFIFSYLIFNTNGRKTGIRYGRGTPEAES

SEQ ID NO: 2358 - protein, 13 aa, Canis lupus familiaris
NEAAQELPADKWV

SEQ ID NO: 2359 - protein, 9 aa, Canis lupus familiaris
NEAFSHGAI

SEQ ID NO: 2360 - protein, 10 aa, Canis lupus familiaris
NEDGTVVLGT

SEQ ID NO: 2361 - protein, 27 aa, Canis lupus familiaris
NEDTFRGPRSRAHADSILRWKTIRVQL

SEQ ID NO: 2362 - protein, 15 aa, Canis lupus familiaris
NEDVGGFAKRHGKRP

SEQ ID NO: 2363 - protein, 10 aa, Canis lupus familiaris
NEEEFLLCPI

SEQ ID NO: 2364 - protein, 9 aa, Canis lupus familiaris
NEEFQEDAP

SEQ ID NO: 2365 - protein, 26 aa, Canis lupus familiaris
NEEKRASCPRGCPASAPAAPPVHHSP

SEQ ID NO: 2366 - protein, 13 aa, Canis lupus familiaris
NEENEADWIINFG

SEQ ID NO: 2367 - protein, 13 aa, Canis lupus familiaris
NEENEADWIINFV

SEQ ID NO: 2368 - protein, 17 aa, Canis lupus familiaris
NEERTKNSPLSSYGNNI

SEQ ID NO: 2369 - protein, 31 aa, Canis lupus familiaris
NEGSYQTLRVTLVALMWNLSQMLRRKEAVMK

SEQ ID NO: 2370 - protein, 17 aa, Canis lupus familiaris
NEICGVKSRATSSRYEF

SEQ ID NO: 2371 - protein, 26 aa, Canis lupus familiaris
NEILRYFPHNKPLLSIKAGIPRENGA

SEQ ID NO: 2372 - protein, 13 aa, Canis lupus familiaris
NEKKEAQRYNRSI

SEQ ID NO: 2373 - protein, 17 aa, Canis lupus familiaris
NEKKVLFLGGMHEPSGG

SEQ ID NO: 2374 - protein, 10 aa, Canis lupus familiaris
NEKNRRHQEY

SEQ ID NO: 2375 - protein, 9 aa, Canis lupus familiaris
NELHHWGRG

SEQ ID NO: 2376 - protein, 16 aa, Canis lupus familiaris
NELNVFAFQTYTSQGL

SEQ ID NO: 2377 - protein, 10 aa, Canis lupus familiaris
NEPRLYKECF

SEQ ID NO: 2378 - protein, 13 aa, Canis lupus familiaris
NERDDILFGFHPS

SEQ ID NO: 2379 - protein, 11 aa, Canis lupus familiaris
NERLSAAKKAE

SEQ ID NO: 2380 - protein, 13 aa, Canis lupus familiaris
NESYFLDNEEKSE

SEQ ID NO: 2381 - protein, 19 aa, Canis lupus familiaris
NEVSTKYFLNVIVNKKVHN

SEQ ID NO: 2382 - protein, 18 aa, Canis lupus familiaris
NEWPFGKVHLYNGNTRKK

SEQ ID NO: 2383 - protein, 11 aa, Canis lupus familiaris
NFARLPHSYPS

SEQ ID NO: 2384 - protein, 14 aa, Canis lupus familiaris
NFCCAEGWTYLSLF

SEQ ID NO: 2385 - protein, 34 aa, Canis lupus familiaris
NFCFFKWTCTVSKYKIWCNTHLITWRKSAEWESW

SEQ ID NO: 2386 - protein, 18 aa, Canis lupus familiaris
NFCKITRRIQNWRILKRL

SEQ ID NO: 2387 - protein, 11 aa, Canis lupus familiaris
NFCWWPFSRYT

SEQ ID NO: 2388 - protein, 14 aa, Canis lupus familiaris
NFEHPSYIREAFVV

SEQ ID NO: 2389 - protein, 23 aa, Canis lupus familiaris
NFEYQRVLVIYLFCDSIGLHCDH

SEQ ID NO: 2390 - protein, 24 aa, Canis lupus familiaris
NFGSYYNSIRKYWQDGCFSSKRDD

SEQ ID NO: 2391 - protein, 34 aa, Canis lupus familiaris
NFHSIEQRESNLPFQCHPCFVHAVSIQSSKKNIY

SEQ ID NO: 2392 - protein, 10 aa, Canis lupus familiaris
NFIFMHWCKS

SEQ ID NO: 2393 - protein, 10 aa, Canis lupus familiaris
NFLAVHISIP

SEQ ID NO: 2394 - protein, 25 aa, Canis lupus familiaris
NFLLSGTVDFEIWNASEYTSYQRDS

SEQ ID NO: 2395 - protein, 10 aa, Canis lupus familiaris
NFLRRKIQLF

SEQ ID NO: 2396 - protein, 14 aa, Canis lupus familiaris
NFLSQAAIRVQGPT

SEQ ID NO: 2397 - protein, 15 aa, Canis lupus familiaris
NFMKQCLLREKIGKD

SEQ ID NO: 2398 - protein, 13 aa, Canis lupus familiaris
NFMVSNTIKSKTS

SEQ ID NO: 2399 - protein, 25 aa, Canis lupus familiaris
NFPSAMDRSRISNQLSRQTTNCRSN

SEQ ID NO: 2400 - protein, 49 aa, Canis lupus familiaris
NFQFPGRDDKSHPHCGALHHHEPWVRGTHRVARKPKGLVQALRHGRPRL

SEQ ID NO: 2401 - protein, 10 aa, Canis lupus familiaris
NFQTERLFKI

SEQ ID NO: 2402 - protein, 15 aa, Canis lupus familiaris
NFRSGERPSFQAVEW

SEQ ID NO: 2403 - protein, 13 aa, Canis lupus familiaris
NFSEGKQLVIFYQ

SEQ ID NO: 2404 - protein, 13 aa, Canis lupus familiaris
NFSFFGVKYNRFT

SEQ ID NO: 2405 - skipped

SEQ ID NO: 2406 - protein, 28 aa, Canis lupus familiaris
NFSTIETHQLEPKEYFMAEQMILRLLLI

SEQ ID NO: 2407 - protein, 9 aa, Canis lupus familiaris
NGAEQDSSH

SEQ ID NO: 2408 - protein, 13 aa, Canis lupus familiaris
NGCVLTGFSRPWL

SEQ ID NO: 2409 - protein, 22 aa, Canis lupus familiaris
NGCYSVWKNTILNSGRSFAKFP

SEQ ID NO: 2410 - protein, 40 aa, Canis lupus familiaris
NGDHRRHPWLRPDLEGKTWPEDSVPQLQARHSVRDSSGLY

SEQ ID NO: 2411 - protein, 16 aa, Canis lupus familiaris
NGEDGHEEDDIYGVPE

SEQ ID NO: 2412 - protein, 22 aa, Canis lupus familiaris
NGEMKLHQCTLPCLWPCSALTP

SEQ ID NO: 2413 - protein, 44 aa, Canis lupus familiaris
NGERKASAPWEVQILGLTISHPSHQSSLAITTHDLLFHGASERI

SEQ ID NO: 2414 - protein, 14 aa, Canis lupus familiaris
NGFHHEQQPHPAHL

SEQ ID NO: 2415 - protein, 31 aa, Canis lupus familiaris
NGIKGRGKWARSSQTETTCQRQTRGQTRNEL

SEQ ID NO: 2416 - protein, 15 aa, Canis lupus familiaris
NGKFCSYRKRTYSGS

SEQ ID NO: 2417 - protein, 11 aa, Canis lupus familiaris
NGKRGKKLWRL

SEQ ID NO: 2418 - protein, 19 aa, Canis lupus familiaris
NGKYSKVGELYIEITSCIE

SEQ ID NO: 2419 - protein, 8 aa, Canis lupus familiaris
NGLCSASL

SEQ ID NO: 2420 - protein, 14 aa, Canis lupus familiaris
NGLEKENGMINQKE

SEQ ID NO: 2421 - protein, 14 aa, Canis lupus familiaris
NGLPETEKMLQLMP

SEQ ID NO: 2422 - protein, 13 aa, Canis lupus familiaris
NGLPFTKNARKWL

SEQ ID NO: 2423 - protein, 10 aa, Canis lupus familiaris
NGNVCRRTQA

SEQ ID NO: 2424 - protein, 13 aa, Canis lupus familiaris
NGPVPYQSREGED

SEQ ID NO: 2425 - protein, 40 aa, Canis lupus familiaris
NGQRGIMTSVVPSRLTSTIPSGQACGICTAATTRIPANQT

SEQ ID NO: 2426 - protein, 9 aa, Canis lupus familiaris
NGQRNFLVL

SEQ ID NO: 2427 - protein, 29 aa, Canis lupus familiaris
NGQRRRGFKGSASRTQRSSAPVAAPASGN

SEQ ID NO: 2428 - protein, 19 aa, Canis lupus familiaris
NGRIKNRRRTCIFCKIFNK

SEQ ID NO: 2429 - protein, 21 aa, Canis lupus familiaris
NGRKIQSRYWTQTSRFSGFNI

SEQ ID NO: 2430 - protein, 13 aa, Canis lupus familiaris
NGSLFSSLPLVLY

SEQ ID NO: 2431 - protein, 25 aa, Canis lupus familiaris
NGSNQNSSVLQDPSSTVCAVWTVPG

SEQ ID NO: 2432 - protein, 13 aa, Canis lupus familiaris
NGSRGNLHQALPR

SEQ ID NO: 2433 - protein, 8 aa, Canis lupus familiaris
NGTEALIP

SEQ ID NO: 2434 - protein, 12 aa, Canis lupus familiaris
NGTSMTDTAKKD

SEQ ID NO: 2435 - protein, 15 aa, Canis lupus familiaris
NGTSPVTCLPCRGSS

SEQ ID NO: 2436 - protein, 32 aa, Canis lupus familiaris
NGVRRYFRTVKYNDNRKQERCKNSERRSSKAG

SEQ ID NO: 2437 - protein, 9 aa, Canis lupus familiaris
NGYTVRSCV

SEQ ID NO: 2438 - protein, 24 aa, Canis lupus familiaris
NHADFNCSVYGHLLPGLQWRILPV

SEQ ID NO: 2439 - protein, 32 aa, Canis lupus familiaris
NHAENQSVFSGAIEHIDRHHNKRSEFHGTGQI

SEQ ID NO: 2440 - protein, 49 aa, Canis lupus familiaris
NHEPGLIPICHRTHQQDFQDPEAAPQPRSSGRGRREWKAVCHPVSCPHG

SEQ ID NO: 2441 - protein, 17 aa, Canis lupus familiaris
NHGNVQAYMGESYPCPH

SEQ ID NO: 2442 - protein, 16 aa, Canis lupus familiaris
NHGTSQVGIRVMSWEA

SEQ ID NO: 2443 - skipped

SEQ ID NO: 2444 - protein, 10 aa, Canis lupus familiaris
NHLNRVLQDK

SEQ ID NO: 2445 - protein, 48 aa, Canis lupus familiaris
NHLVHYFLKHIRLIENSKSRKLCFQLDSPFPNLYCTAVILLSLEQNFT

SEQ ID NO: 2446 - protein, 9 aa, Canis lupus familiaris
NHNKNFAAD

SEQ ID NO: 2447 - protein, 44 aa, Canis lupus familiaris
NHPGGPGAAQVGLQGGHPQREERGDHDRQRLVQLPGEPQQAGQR

SEQ ID NO: 2448 - protein, 18 aa, Canis lupus familiaris
NHQCCGSVCLPLVWQWQR

SEQ ID NO: 2449 - protein, 19 aa, Canis lupus familiaris
NHRRSTRISKQMEIKRSQI

SEQ ID NO: 2450 - protein, 17 aa, Canis lupus familiaris
NHSGVINLGTCFVKHQG

SEQ ID NO: 2451 - protein, 26 aa, Canis lupus familiaris
NHSQPSKTWAQHTPAALSSAQPRRDI

SEQ ID NO: 2452 - protein, 8 aa, Canis lupus familiaris
NHSRGRSS

SEQ ID NO: 2453 - protein, 44 aa, Canis lupus familiaris
NHTCAGEGPVSRARSRRVRREKDRQSVLASGRNANQGAFGTGFS

SEQ ID NO: 2454 - protein, 20 aa, Canis lupus familiaris
NHTNSKEQELESQQIFLLMT

SEQ ID NO: 2455 - protein, 13 aa, Canis lupus familiaris
NHVYIQENPAMAR

SEQ ID NO: 2456 - protein, 8 aa, Canis lupus familiaris
NICLHRNS

SEQ ID NO: 2457 - protein, 15 aa, Canis lupus familiaris
NIEGHLWAFSPRCLS

SEQ ID NO: 2458 - protein, 14 aa, Canis lupus familiaris
NIERFARSPVPFGN

SEQ ID NO: 2459 - protein, 13 aa, Canis lupus familiaris
NIFRIRLIAKMMM

SEQ ID NO: 2460 - protein, 10 aa, Canis lupus familiaris
NIFRWCKKRT

SEQ ID NO: 2461 - protein, 25 aa, Canis lupus familiaris
NIFTTRASEKTSKDPWQPCSSSCTF

SEQ ID NO: 2462 - protein, 36 aa, Canis lupus familiaris
NIGTWIKSTGASGSVRTYLQYALLPMWGCCSVWSVP

SEQ ID NO: 2463 - protein, 20 aa, Canis lupus familiaris
NIIHRVKWPKLSLEDSKLLR

SEQ ID NO: 2464 - skipped

SEQ ID NO: 2465 - protein, 9 aa, Canis lupus familiaris
NILKKIQGS

SEQ ID NO: 2466 - protein, 9 aa, Canis lupus familiaris
NILYEKGRN

SEQ ID NO: 2467 - protein, 9 aa, Canis lupus familiaris
NIMKMHKYP

SEQ ID NO: 2468 - protein, 11 aa, Canis lupus familiaris
NINNISRQTRL

SEQ ID NO: 2469 - protein, 11 aa, Canis lupus familiaris
NIPASKGKKLS

SEQ ID NO: 2470 - protein, 26 aa, Canis lupus familiaris
NIPEEVQTIGREIAAVYFFAPVSCKA

SEQ ID NO: 2471 - protein, 11 aa, Canis lupus familiaris
NIPSAKTCTTA

SEQ ID NO: 2472 - protein, 10 aa, Canis lupus familiaris
NISKRSLMHL

SEQ ID NO: 2473 - protein, 45 aa, Canis lupus familiaris
NISQLLLQPQLLMGMKPVQANLLLSLQILQEWIMSCGQKCEDMRC

SEQ ID NO: 2474 - protein, 8 aa, Canis lupus familiaris
NISQWSDE

SEQ ID NO: 2475 - protein, 9 aa, Canis lupus familiaris
NITQKQLLR

SEQ ID NO: 2476 - protein, 19 aa, Canis lupus familiaris
NITRSKFSAGFQTLNSFFE

SEQ ID NO: 2477 - protein, 15 aa, Canis lupus familiaris
NIVGPNTTTENRVIQ

SEQ ID NO: 2478 - protein, 15 aa, Canis lupus familiaris
NIVSMIYTQWEQGIC

SEQ ID NO: 2479 - protein, 14 aa, Canis lupus familiaris
NIVTKHTVWKRVLK

SEQ ID NO: 2480 - protein, 15 aa, Canis lupus familiaris
NIWWFFIIASGGQNK

SEQ ID NO: 2481 - protein, 39 aa, Canis lupus familiaris
NKAAAGPHGREGDTGRRDSRHEGYVRSEGKKNQCSSEED

SEQ ID NO: 2482 - protein, 10 aa, Canis lupus familiaris
NKAEPTYSCN

SEQ ID NO: 2483 - skipped

SEQ ID NO: 2484 - protein, 16 aa, Canis lupus familiaris
NKAQTNVAQKLIRARI

SEQ ID NO: 2485 - protein, 8 aa, Canis lupus familiaris
NKATKWIL

SEQ ID NO: 2486 - protein, 15 aa, Canis lupus familiaris
NKCFFKQLECCYWKC

SEQ ID NO: 2487 - protein, 13 aa, Canis lupus familiaris
NKCRELCAIVEFC

SEQ ID NO: 2488 - skipped

SEQ ID NO: 2489 - protein, 28 aa, Canis lupus familiaris
NKEKEESSPIEPRDHNEPGISEHVCWNV

SEQ ID NO: 2490 - protein, 11 aa, Canis lupus familiaris
NKEKKESSNFI

SEQ ID NO: 2491 - protein, 79 aa, Canis lupus familiaris
NKENLDAGCLHHWARQHMALPLPVSSERRRQLYPDVLLHAPLVRDPPLVHGDDHGALAAYGQHPGLEAARPLAGRHRIR

SEQ ID NO: 2492 - protein, 23 aa, Canis lupus familiaris
NKENQKEQTALHRGRQRCGCVCL

SEQ ID NO: 2493 - protein, 93 aa, Canis lupus familiaris
NKERRGRGCKKKKGGGEESPGEEEEGQGQETGPEGKRQAPPQETEGQSHSPRCPGALLFRGVGGEEVPAGSEEGGGSPVATGTLEENCRIHTV

SEQ ID NO: 2494 - protein, 11 aa, Canis lupus familiaris
NKEWDVEHKAG

SEQ ID NO: 2495 - protein, 13 aa, Canis lupus familiaris
NKFEVVLGTFHLM

SEQ ID NO: 2496 - protein, 28 aa, Canis lupus familiaris
NKGCYYSDQVHFGEPELESHHSSYRFPL

SEQ ID NO: 2497 - protein, 8 aa, Canis lupus familiaris
NKGKGNET

SEQ ID NO: 2498 - protein, 33 aa, Canis lupus familiaris
NKGRLWPSSTGRGLSPRVPPGRCQMGHTVGNHC

SEQ ID NO: 2499 - protein, 54 aa, Canis lupus familiaris
NKGSHSGRMELQQGKVTLCFGRQIYWQISSDVDESRRISGKSRRHHFAEPGHIS

SEQ ID NO: 2500 - protein, 35 aa, Canis lupus familiaris
NKGSTNETNERRTRKSQIDRVQEKQRDCSIEKRST

SEQ ID NO: 2501 - protein, 8 aa, Canis lupus familiaris
NKHFLEEV

SEQ ID NO: 2502 - protein, 14 aa, Canis lupus familiaris
NKILVCTMKAVLKR

SEQ ID NO: 2503 - protein, 12 aa, Canis lupus familiaris
NKKDDNTHLKTF

SEQ ID NO: 2504 - protein, 9 aa, Canis lupus familiaris
NKKIYLLQK

SEQ ID NO: 2505 - protein, 32 aa, Canis lupus familiaris
NKKMTQQYLLNLKSQVKTIKTQKCLKKLHLNL

SEQ ID NO: 2506 - protein, 19 aa, Canis lupus familiaris
NKKVCLLLLMEKEKITFLT

SEQ ID NO: 2507 - protein, 27 aa, Canis lupus familiaris
NKKVLWAVLVCVLHSTPRLFQQKVHGH

SEQ ID NO: 2508 - protein, 18 aa, Canis lupus familiaris
NKLRKIQKFRVAILVLNL

SEQ ID NO: 2509 - protein, 38 aa, Canis lupus familiaris
NKMDEHESRFWPPLLSRLGQPLCHARPREGRPVPVCGL

SEQ ID NO: 2510 - protein, 47 aa, Canis lupus familiaris
NKMNAVDVGNCYSIQTTIEDLMEKDSGNAVIARKLSATTQHLCINQQ

SEQ ID NO: 2511 - protein, 30 aa, Canis lupus familiaris
NKNMKRLVKRRCPLLLKFYVRGFLQNLPCT

SEQ ID NO: 2512 - protein, 21 aa, Canis lupus familiaris
NKNNSELYFTGRIRHTFFRGI

SEQ ID NO: 2513 - protein, 16 aa, Canis lupus familiaris
NKNRYQRKEREEAKSG

SEQ ID NO: 2514 - protein, 22 aa, Canis lupus familiaris
NKPHPGDFSAVGTISSFSTEHA

SEQ ID NO: 2515 - protein, 20 aa, Canis lupus familiaris
NKPNCSSPKLCHPKFLHPIL

SEQ ID NO: 2516 - protein, 10 aa, Canis lupus familiaris
NKQAPRRETR

SEQ ID NO: 2517 - protein, 10 aa, Canis lupus familiaris
NKRAVLQRGN

SEQ ID NO: 2518 - protein, 38 aa, Canis lupus familiaris
NKRFPRIQLCSCSSAWASPQLLRHRPCQDPGQAPPENL

SEQ ID NO: 2519 - protein, 40 aa, Canis lupus familiaris
NKRFPRIQLCSCSSAWASPQLLRHRPCQDPGQAPPGSRGL

SEQ ID NO: 2520 - protein, 9 aa, Canis lupus familiaris
NKRKCFRIP

SEQ ID NO: 2521 - protein, 8 aa, Canis lupus familiaris
NKRNVSCS

SEQ ID NO: 2522 - protein, 13 aa, Canis lupus familiaris
NKSCKRARNQRWW

SEQ ID NO: 2523 - protein, 30 aa, Canis lupus familiaris
NKSCRLLRRKSQNPSMRPLPLSQFLAPLMK

SEQ ID NO: 2524 - protein, 20 aa, Canis lupus familiaris
NKSFFISLFLFLQVEGSISF

SEQ ID NO: 2525 - protein, 41 aa, Canis lupus familiaris
NKTDQIRGRGFGRTIKQCRRDPTSLTGPFSAGYTCYQGGAS

SEQ ID NO: 2526 - protein, 19 aa, Canis lupus familiaris
NKTPAPTASNKRQPRAPAI

SEQ ID NO: 2527 - protein, 23 aa, Canis lupus familiaris
NKTYCCCGTVYFNLHKTTKNRYS

SEQ ID NO: 2528 - protein, 18 aa, Canis lupus familiaris
NKVFTVWGSLSFSLQLQG

SEQ ID NO: 2529 - protein, 60 aa, Canis lupus familiaris
NLATFTTFINGRVVNSIFLLFLQRNGVQVVHMTSLVPTSYNMTCLGLHMRTLRSMMLKST

SEQ ID NO: 2530 - protein, 34 aa, Canis lupus familiaris
NLAWRRVLRRPWILRRNQLGFCRWGSRISVWNVA

SEQ ID NO: 2531 - protein, 32 aa, Canis lupus familiaris
NLDYQEQLGHRLGHAGLHTDSQKPGQPLGKHH

SEQ ID NO: 2532 - protein, 16 aa, Canis lupus familiaris
NLEYCRTTLKAKELFL

SEQ ID NO: 2533 - skipped

SEQ ID NO: 2534 - protein, 13 aa, Canis lupus familiaris
NLGWNLLASGGDV

SEQ ID NO: 2535 - protein, 18 aa, Canis lupus familiaris
NLIFQAPPGGQRATAGSK

SEQ ID NO: 2536 - protein, 12 aa, Canis lupus familiaris
NLILEEKVVIKG

SEQ ID NO: 2537 - protein, 28 aa, Canis lupus familiaris
NLILEEKVVIKGIPLDHWTMKVSNKNLL

SEQ ID NO: 2538 - skipped

SEQ ID NO: 2539 - protein, 15 aa, Canis lupus familiaris
NLKFGERVGCLSKGS

SEQ ID NO: 2540 - protein, 25 aa, Canis lupus familiaris
NLKLRRLSPATQLLVPSSSPWPLVS

SEQ ID NO: 2541 - protein, 8 aa, Canis lupus familiaris
NLKSCTTV

SEQ ID NO: 2542 - protein, 37 aa, Canis lupus familiaris
NLKSNTSLNLPQAGLDPNLHGAGSKRVGVAVFKKYEI

SEQ ID NO: 2543 - protein, 42 aa, Canis lupus familiaris
NLKTLYGSTGWPWKVNLFLANCISGLTLYLATNSEDQKQSVL

SEQ ID NO: 2544 - skipped

SEQ ID NO: 2545 - protein, 16 aa, Canis lupus familiaris
NLLNEYIKNLIQLEKF

SEQ ID NO: 2546 - protein, 9 aa, Canis lupus familiaris
NLLPEVPPH

SEQ ID NO: 2547 - protein, 16 aa, Canis lupus familiaris
NLNTCFPSLHCAGLSL

SEQ ID NO: 2548 - protein, 13 aa, Canis lupus familiaris
NLPSSSLRVSSES

SEQ ID NO: 2549 - protein, 38 aa, Canis lupus familiaris
NLPYCQLSVTGKGHIDEKASRFFTFPILIHGENRKRNN

SEQ ID NO: 2550 - skipped

SEQ ID NO: 2551 - protein, 69 aa, Canis lupus familiaris
NLQDSDKLIYHTTSCQKLLKIQKKRVIISVLKVFFRSWILLLLPVILVNLLNLVVQINSLRELSIITCQ

SEQ ID NO: 2552 - protein, 18 aa, Canis lupus familiaris
NLQILMKFAMRLKQKQIE

SEQ ID NO: 2553 - protein, 8 aa, Canis lupus familiaris
NLQLFYKH

SEQ ID NO: 2554 - protein, 14 aa, Canis lupus familiaris
NLQTLFSQITPAPF

SEQ ID NO: 2555 - protein, 8 aa, Canis lupus familiaris
NLRQTTLL

SEQ ID NO: 2556 - protein, 27 aa, Canis lupus familiaris
NLSGLQAKSGSFPRRLRLRHRQQSRRK

SEQ ID NO: 2557 - protein, 21 aa, Canis lupus familiaris
NLSSKKKSCFMLEKTENKIVW

SEQ ID NO: 2558 - protein, 9 aa, Canis lupus familiaris
NLSSQKRQT

SEQ ID NO: 2559 - protein, 10 aa, Canis lupus familiaris
NLTCSPGPLC

SEQ ID NO: 2560 - protein, 18 aa, Canis lupus familiaris
NLTNLGRCLYLAPNWYNH

SEQ ID NO: 2561 - protein, 16 aa, Canis lupus familiaris
NLVQQDFLLQRIKTLK

SEQ ID NO: 2562 - protein, 11 aa, Canis lupus familiaris
NLVSQQKTLQF

SEQ ID NO: 2563 - protein, 13 aa, Canis lupus familiaris
NLWASLIKLLFKK

SEQ ID NO: 2564 - protein, 11 aa, Canis lupus familiaris
NLWVQRIWRSL

SEQ ID NO: 2565 - protein, 15 aa, Canis lupus familiaris
NLYPRRIWSNSTESQ

SEQ ID NO: 2566 - protein, 8 aa, Canis lupus familiaris
NLYPSRCH

SEQ ID NO: 2567 - protein, 30 aa, Canis lupus familiaris
NLYRLQRPILWVGKGSRFLCPSVTQQQIDI

SEQ ID NO: 2568 - protein, 11 aa, Canis lupus familiaris
NMCKDRLLCLA

SEQ ID NO: 2569 - protein, 31 aa, Canis lupus familiaris
NMDPFARKLPLKNVRLLIQADKELKELISQQ

SEQ ID NO: 2570 - protein, 15 aa, Canis lupus familiaris
NMEESWHCLFGLSYL

SEQ ID NO: 2571 - protein, 18 aa, Canis lupus familiaris
NMESRLFSFDISQTTPAR

SEQ ID NO: 2572 - protein, 10 aa, Canis lupus familiaris
NMFKKPRNKI

SEQ ID NO: 2573 - protein, 10 aa, Canis lupus familiaris
NMGQSEDCKV

SEQ ID NO: 2574 - protein, 19 aa, Canis lupus familiaris
NMHVMIIRKVCFYIVLLTS

SEQ ID NO: 2575 - protein, 9 aa, Canis lupus familiaris
NMIYNLKRH

SEQ ID NO: 2576 - protein, 11 aa, Canis lupus familiaris
NMLTLQIICFL

SEQ ID NO: 2577 - skipped

SEQ ID NO: 2578 - protein, 12 aa, Canis lupus familiaris
NMSHPDLKKLLL

SEQ ID NO: 2579 - protein, 9 aa, Canis lupus familiaris
NMSQTLNLV

SEQ ID NO: 2580 - protein, 10 aa, Canis lupus familiaris
NMSRCFSFQH

SEQ ID NO: 2581 - protein, 51 aa, Canis lupus familiaris
NMSRILNYQVLKKISRSFMKLYHSLVICLRLRTKLEKALLALFIWPQHSYE

SEQ ID NO: 2582 - protein, 35 aa, Canis lupus familiaris
NMSRRCQQTPLVTLFSRAWARRESTSASPRTHPPA

SEQ ID NO: 2583 - protein, 15 aa, Canis lupus familiaris
NMSSWPRIYHRWKRY

SEQ ID NO: 2584 - protein, 14 aa, Canis lupus familiaris
NNACKLPEASRDPE

SEQ ID NO: 2585-2586 - skipped (2 entries)

SEQ ID NO: 2587 - protein, 11 aa, Canis lupus familiaris
NNFSFASHRFP

SEQ ID NO: 2588 - protein, 8 aa, Canis lupus familiaris
NNHQEEHS

SEQ ID NO: 2589 - protein, 10 aa, Canis lupus familiaris
NNHSYLLVST

SEQ ID NO: 2590 - protein, 25 aa, Canis lupus familiaris
NNKKKLRQQLQPHLQNQESSVVLVG

SEQ ID NO: 2591 - protein, 13 aa, Canis lupus familiaris
NNKRHRVKRPADT

SEQ ID NO: 2592 - skipped

SEQ ID NO: 2593 - protein, 18 aa, Canis lupus familiaris
NNPEVKNTILSLIGGMHA

SEQ ID NO: 2594 - protein, 12 aa, Canis lupus familiaris
NNPKEIPSCHGC

SEQ ID NO: 2595 - protein, 24 aa, Canis lupus familiaris
NNRDNSRKQYWKTATPRHMWNSSC

SEQ ID NO: 2596 - skipped

SEQ ID NO: 2597 - protein, 9 aa, Canis lupus familiaris
NNRNPYPEA

SEQ ID NO: 2598 - protein, 10 aa, Canis lupus familiaris
NNRTEKESLW

SEQ ID NO: 2599 - protein, 9 aa, Canis lupus familiaris
NNRTEMHAV

SEQ ID NO: 2600 - skipped

SEQ ID NO: 2601 - protein, 35 aa, Canis lupus familiaris
NNTFLGYPFCQPASQGPETNTDGFLPTSQDGCNPN

SEQ ID NO: 2602 - protein, 27 aa, Canis lupus familiaris
NNTYLNLEPQMLWDNLLILIILILLRL

SEQ ID NO: 2603 - protein, 15 aa, Canis lupus familiaris
NNVLQYAYKNCSEAS

SEQ ID NO: 2604 - protein, 10 aa, Canis lupus familiaris
NPAAVPCQRI

SEQ ID NO: 2605 - protein, 10 aa, Canis lupus familiaris
NPAKTRIRHC

SEQ ID NO: 2606 - protein, 28 aa, Canis lupus familiaris
NPDLAHSGPKESAGDVYQAEVRADEEGL

SEQ ID NO: 2607 - protein, 21 aa, Canis lupus familiaris
NPEAAEERPAANDTKRTHMYP

SEQ ID NO: 2608 - protein, 17 aa, Canis lupus familiaris
NPEPVEASWHRSAFHSR

SEQ ID NO: 2609 - protein, 21 aa, Canis lupus familiaris
NPEQYPGDAGTDEPDPVCGGL

SEQ ID NO: 2610 - protein, 20 aa, Canis lupus familiaris
NPFKRLRGCQTPFWLRGHHL

SEQ ID NO: 2611 - protein, 12 aa, Canis lupus familiaris
NPFPRDTKWTLK

SEQ ID NO: 2612 - protein, 13 aa, Canis lupus familiaris
NPGEQAACVPGLC

SEQ ID NO: 2613 - protein, 11 aa, Canis lupus familiaris
NPGGRGQSSPP

SEQ ID NO: 2614 - protein, 41 aa, Canis lupus familiaris
NPGIKFLYLPWSGPHSRLLGLPSFQSAHYHCCWGAPANPQD

SEQ ID NO: 2615 - protein, 15 aa, Canis lupus familiaris
NPGSAARGEEDRGIP

SEQ ID NO: 2616 - protein, 8 aa, Canis lupus familiaris
NPHCRKKP

SEQ ID NO: 2617 - skipped

SEQ ID NO: 2618 - protein, 13 aa, Canis lupus familiaris
NPKGIIRKLLGKR

SEQ ID NO: 2619 - protein, 22 aa, Canis lupus familiaris
NPKSRTAMQASSVLPEQATWTK

SEQ ID NO: 2620 - protein, 14 aa, Canis lupus familiaris
NPLLFIPIFLLQTS

SEQ ID NO: 2621 - protein, 17 aa, Canis lupus familiaris
NPLMKHLEKYKKVRKIL

SEQ ID NO: 2622 - protein, 46 aa, Canis lupus familiaris
NPLNAVTVGKPIAGRLTLQLIRKSIMERDPLCATIVGKRLRIKHNW

SEQ ID NO: 2623 - protein, 43 aa, Canis lupus familiaris
NPPDSSLLLRSPAFPFCSSSSPSSSSTYAPSMVHHHMKKPPKD

SEQ ID NO: 2624 - skipped

SEQ ID NO: 2625 - protein, 22 aa, Canis lupus familiaris
NPPENQKQAVGPRKPEKEEGIY

SEQ ID NO: 2626 - protein, 41 aa, Canis lupus familiaris
NPPERAGERASAEKARGRTLERARLDPGRRGRRRQPKMAGL

SEQ ID NO: 2627 - protein, 49 aa, Canis lupus familiaris
NPPGSLSPQRQVRAALCHLRPHRGICPRAAGLEARRSAGHQPPGHPQGL

SEQ ID NO: 2628 - protein, 8 aa, Canis lupus familiaris
NPPSASYE

SEQ ID NO: 2629 - protein, 11 aa, Canis lupus familiaris
NPRFAEPPGVE

SEQ ID NO: 2630 - protein, 12 aa, Canis lupus familiaris
NPRQFEPLPSPL

SEQ ID NO: 2631 - protein, 9 aa, Canis lupus familiaris
NPRRWHLIA

SEQ ID NO: 2632 - protein, 21 aa, Canis lupus familiaris
NPRSDIQWHHFSIYSFESVQL

SEQ ID NO: 2633 - protein, 27 aa, Canis lupus familiaris
NPSCSQRSISKHRRFFHEWLLVQIKRQ

SEQ ID NO: 2634 - protein, 25 aa, Canis lupus familiaris
NPSEGANCLSEERVYSAFLLHAVHQ

SEQ ID NO: 2635 - protein, 61 aa, Canis lupus familiaris
NPSEGANCLSEERVYSAFLLHAVPHWIYSSTCPPTASSHQENLFKLLKRYFKSKGCDQCPV

SEQ ID NO: 2636 - protein, 12 aa, Canis lupus familiaris
NPSGKRFSGETI

SEQ ID NO: 2637 - protein, 24 aa, Canis lupus familiaris
NPVHSKELTFQTFLSLISVKKVHG

SEQ ID NO: 2638 - protein, 15 aa, Canis lupus familiaris
NPWNRFIWKSHVGET

SEQ ID NO: 2639 - protein, 14 aa, Canis lupus familiaris
NPWPPQKNTLSPVK

SEQ ID NO: 2640 - protein, 36 aa, Canis lupus familiaris
NPYLKKQSQRRGKLSQSHLLYQNFSLFALILMNSGN

SEQ ID NO: 2641 - protein, 8 aa, Canis lupus familiaris
NPYWRETL

SEQ ID NO: 2642 - protein, 15 aa, Canis lupus familiaris
NQAKICRPSWRIAHY

SEQ ID NO: 2643 - protein, 8 aa, Canis lupus familiaris
NQAQQRNW

SEQ ID NO: 2644 - protein, 16 aa, Canis lupus familiaris
NQARNLCNGRHPGTCQ

SEQ ID NO: 2645 - protein, 10 aa, Canis lupus familiaris
NQASCTYQKT

SEQ ID NO: 2646 - protein, 54 aa, Canis lupus familiaris
NQASTSPATRKDQTLTWDLPGQLLAPTMPIGTREKDCLKATRQIYLGALEPLKT

SEQ ID NO: 2647 - protein, 20 aa, Canis lupus familiaris
NQCISLSTLTLGCSPPITTT

SEQ ID NO: 2648 - protein, 10 aa, Canis lupus familiaris
NQEERKKRRG

SEQ ID NO: 2649 - protein, 19 aa, Canis lupus familiaris
NQEKLKEVSYTAPHFASCS

SEQ ID NO: 2650 - protein, 11 aa, Canis lupus familiaris
NQEMDGHLPRV

SEQ ID NO: 2651 - protein, 50 aa, Canis lupus familiaris
NQEPKEETESYRATERTSSSWKTARKKSVGENSKRESPSPGAGRFGIGYL

SEQ ID NO: 2652 - protein, 11 aa, Canis lupus familiaris
NQEVPDRRQPQ

SEQ ID NO: 2653 - protein, 31 aa, Canis lupus familiaris
NQFFTEEGGSENANTTIAVWSQKLFQRLQRC

SEQ ID NO: 2654 - skipped

SEQ ID NO: 2655 - protein, 18 aa, Canis lupus familiaris
NQGGYRRGGKQGFMCNDR

SEQ ID NO: 2656 - protein, 45 aa, Canis lupus familiaris
NQHSTCLPLERFPLHLGILQSLKQVSLEILLFILEKQRMVGQQLL

SEQ ID NO: 2657 - protein, 12 aa, Canis lupus familiaris
NQIGSHEQLSCQ

SEQ ID NO: 2658 - protein, 9 aa, Canis lupus familiaris
NQKALQPME

SEQ ID NO: 2659 - protein, 30 aa, Canis lupus familiaris
NQLFKRRMVIYKRAHIQQFLPELTEKSGKI

SEQ ID NO: 2660 - protein, 26 aa, Canis lupus familiaris
NQLLQERRPTVWRGQGGGQPAFLQDI

SEQ ID NO: 2661 - protein, 51 aa, Canis lupus familiaris
NQLRQWPLHHPKTMELRARTPLSASPCPLPQASPAAPGKHPSPSWAPTQPW

SEQ ID NO: 2662 - protein, 14 aa, Canis lupus familiaris
NQLYHSIFNKFGDF

SEQ ID NO: 2663 - protein, 11 aa, Canis lupus familiaris
NQNLNFLYIRL

SEQ ID NO: 2664 - protein, 30 aa, Canis lupus familiaris
NQNQKWIHLLEESVLPHQILKAVFTRVRKM

SEQ ID NO: 2665 - protein, 17 aa, Canis lupus familiaris
NQPKLSCKPADSLYGLV

SEQ ID NO: 2666 - skipped

SEQ ID NO: 2667 - protein, 44 aa, Canis lupus familiaris
NQPQSQARAAHPCHLDLCPHEENLYHQIMSLGSQEVQESFHQAK

SEQ ID NO: 2668 - skipped

SEQ ID NO: 2669 - protein, 19 aa, Canis lupus familiaris
NQQDRNRQLYKQLLWDTKE

SEQ ID NO: 2670 - protein, 13 aa, Canis lupus familiaris
NQQRRKDSWLCEN

SEQ ID NO: 2671 - protein, 23 aa, Canis lupus familiaris
NQQSYLLHLLQVYLQMLSVWFLQ

SEQ ID NO: 2672 - protein, 10 aa, Canis lupus familiaris
NQRLHQLPQR

SEQ ID NO: 2673 - protein, 31 aa, Canis lupus familiaris
NQRRAPAGSLPSGGTTPPSTEPGEQQYLLRL

SEQ ID NO: 2674 - protein, 19 aa, Canis lupus familiaris
NQRRNSPSIREKKVVRNQI

SEQ ID NO: 2675 - protein, 11 aa, Canis lupus familiaris
NQRSTDEGRRL

SEQ ID NO: 2676 - protein, 16 aa, Canis lupus familiaris
NQSDYFSSRVPPCLYV

SEQ ID NO: 2677 - protein, 11 aa, Canis lupus familiaris
NQSGRKGGDAT

SEQ ID NO: 2678 - protein, 12 aa, Canis lupus familiaris
NQSLLLGCTLII

SEQ ID NO: 2679 - protein, 21 aa, Canis lupus familiaris
NQSPVSPGSVPPGFLHCYIYS

SEQ ID NO: 2680 - protein, 15 aa, Canis lupus familiaris
NQSSQRRLRRQTPRT

SEQ ID NO: 2681 - protein, 39 aa, Canis lupus familiaris
NQTYFTSNQIKSRSKENSNRHKEFAITITKHCLLFTPDC

SEQ ID NO: 2682 - protein, 50 aa, Canis lupus familiaris
NQTYFTSNQIKSRSKENSNRHKGSWPRTCSYIGPPTGFLCFLLSQTVHRC

SEQ ID NO: 2683 - protein, 16 aa, Canis lupus familiaris
NQVTPKAVLQSKENIY

SEQ ID NO: 2684 - protein, 11 aa, Canis lupus familiaris
NRANGIIGGKL

SEQ ID NO: 2685 - protein, 17 aa, Canis lupus familiaris
NRARIPQIPKPFGHRDH

SEQ ID NO: 2686 - protein, 11 aa, Canis lupus familiaris
NRCAKSCCQSL

SEQ ID NO: 2687 - protein, 11 aa, Canis lupus familiaris
NRCRGARQGQR

SEQ ID NO: 2688 - protein, 8 aa, Canis lupus familiaris
NRCSTTIK

SEQ ID NO: 2689 - protein, 33 aa, Canis lupus familiaris
NRDSSPAARISFRFIFSVCLLTSCFKDQAENHI

SEQ ID NO: 2690 - protein, 44 aa, Canis lupus familiaris
NREEQKTEVQTGQASRFVREHRVWGARTPPAPAAGPERHGLVTV

SEQ ID NO: 2691 - protein, 11 aa, Canis lupus familiaris
NREERITYTPL

SEQ ID NO: 2692 - protein, 27 aa, Canis lupus familiaris
NRERKLSGKQNDLTRSLPTKFPRAARD

SEQ ID NO: 2693 - protein, 33 aa, Canis lupus familiaris
NRFSWKSWCWWCAEHSQEVRTKDCVDKCSGRTG

SEQ ID NO: 2694 - protein, 30 aa, Canis lupus familiaris
NRFTPQIVMRSHISLIVLLLRMKNHQQTPC

SEQ ID NO: 2695 - protein, 19 aa, Canis lupus familiaris
NRGFATYSYQQRTIRGAHR

SEQ ID NO: 2696 - protein, 8 aa, Canis lupus familiaris
NRGFLGSS

SEQ ID NO: 2697 - protein, 10 aa, Canis lupus familiaris
NRGICSGSKA

SEQ ID NO: 2698 - protein, 8 aa, Canis lupus familiaris
NRGIGKER

SEQ ID NO: 2699 - protein, 19 aa, Canis lupus familiaris
NRICVERIQPETSLRIKAQ

SEQ ID NO: 2700 - protein, 18 aa, Canis lupus familiaris
NRILPGAGSFGQPSSGHE

SEQ ID NO: 2701 - protein, 8 aa, Canis lupus familiaris
NRIPIKDV

SEQ ID NO: 2702 - protein, 22 aa, Canis lupus familiaris
NRIRENKYHCKCCQTPGHGYSE

SEQ ID NO: 2703 - protein, 30 aa, Canis lupus familiaris
NRISPILTIMKILSYLKKKNQLLIFQQICP

SEQ ID NO: 2704 - protein, 8 aa, Canis lupus familiaris
NRKCRAVF

SEQ ID NO: 2705 - protein, 9 aa, Canis lupus familiaris
NRKCRKNCF

SEQ ID NO: 2706 - protein, 10 aa, Canis lupus familiaris
NRKEEKLVFD

SEQ ID NO: 2707 - protein, 22 aa, Canis lupus familiaris
NRKKLPRKSKTIKTLHLCLVLV

SEQ ID NO: 2708 - protein, 9 aa, Canis lupus familiaris
NRKPMCYGL

SEQ ID NO: 2709 - skipped

SEQ ID NO: 2710 - protein, 36 aa, Canis lupus familiaris
NRKTSGQGPAQEPSPPCATSFQLRQLSCPTARTVCI

SEQ ID NO: 2711 - skipped

SEQ ID NO: 2712 - protein, 10 aa, Canis lupus familiaris
NRMPRQSTEI

SEQ ID NO: 2713 - protein, 27 aa, Canis lupus familiaris
NRMYNEGWTGRAPHSGGRLRSQRSEWI

SEQ ID NO: 2714 - skipped

SEQ ID NO: 2715 - protein, 15 aa, Canis lupus familiaris
NRNYKGIFGQSKKSF

SEQ ID NO: 2716 - protein, 25 aa, Canis lupus familiaris
NRPRGTLLRNFLPNSVIFLQRTTFL

SEQ ID NO: 2717 - protein, 18 aa, Canis lupus familiaris
NRPSLFMKKNLHHLMAPQ

SEQ ID NO: 2718 - protein, 19 aa, Canis lupus familiaris
NRQAANLSIVLRCNHLWHV

SEQ ID NO: 2719 - protein, 10 aa, Canis lupus familiaris
NRQDTGRARI

SEQ ID NO: 2720 - protein, 10 aa, Canis lupus familiaris
NRQIWRKNCT

SEQ ID NO: 2721 - protein, 8 aa, Canis lupus familiaris
NRRCNCHF

SEQ ID NO: 2722 - protein, 9 aa, Canis lupus familiaris
NRRNRCKGT

SEQ ID NO: 2723 - protein, 12 aa, Canis lupus familiaris
NRRQFWTKKLID

SEQ ID NO: 2724 - protein, 40 aa, Canis lupus familiaris
NRRQSAVCSLSPRLHSALHFRDSLGHLQASSQPDPGTQLS

SEQ ID NO: 2725 - protein, 11 aa, Canis lupus familiaris
NRRRDCNLEGQ

SEQ ID NO: 2726 - protein, 8 aa, Canis lupus familiaris
NRRTLEKR

SEQ ID NO: 2727 - protein, 13 aa, Canis lupus familiaris
NRRYERKGTNKSN

SEQ ID NO: 2728 - protein, 11 aa, Canis lupus familiaris
NRSCSCGLFVR

SEQ ID NO: 2729 - protein, 11 aa, Canis lupus familiaris
NRSLSSWQPGF

SEQ ID NO: 2730 - protein, 9 aa, Canis lupus familiaris
NRSPGCEAN

SEQ ID NO: 2731 - protein, 16 aa, Canis lupus familiaris
NRSRKLFIWPSGPYDG

SEQ ID NO: 2732 - protein, 21 aa, Canis lupus familiaris
NRSSGPLSLQEIHFKTCYQIY

SEQ ID NO: 2733 - protein, 32 aa, Canis lupus familiaris
NRSVTRILQSRARETESADKRGVWRENQNAGG

SEQ ID NO: 2734 - protein, 14 aa, Canis lupus familiaris
NRTESQGHGFGRGE

SEQ ID NO: 2735 - protein, 17 aa, Canis lupus familiaris
NRTVGEMMRSWGHEHTE

SEQ ID NO: 2736 - protein, 9 aa, Canis lupus familiaris
NRVKLNPKA

SEQ ID NO: 2737 - protein, 9 aa, Canis lupus familiaris
NRWNFITRT

SEQ ID NO: 2738 - protein, 52 aa, Canis lupus familiaris
NRWTANHYCMHREPSVPSKKLLEWSLEVRVEVYNHSFNHSSGWHLENSGSLL

SEQ ID NO: 2739 - protein, 10 aa, Canis lupus familiaris
NSALQYCNPA

SEQ ID NO: 2740 - protein, 14 aa, Canis lupus familiaris
NSAVIQSTLFTSEG

SEQ ID NO: 2741 - protein, 10 aa, Canis lupus familiaris
NSCGSCSTPF

SEQ ID NO: 2742 - skipped

SEQ ID NO: 2743 - protein, 15 aa, Canis lupus familiaris
NSCLLINDFVHIPEF

SEQ ID NO: 2744 - protein, 12 aa, Canis lupus familiaris
NSCPENYRKKRG

SEQ ID NO: 2745 - protein, 11 aa, Canis lupus familiaris
NSCRCNSFSSC

SEQ ID NO: 2746 - skipped

SEQ ID NO: 2747 - protein, 8 aa, Canis lupus familiaris
NSEKNFQY

SEQ ID NO: 2748 - protein, 69 aa, Canis lupus familiaris
NSEKQLQTCWAGDKGNLRRGETPQMVLIYPWQQLTSKIQKSQPIDFMVHKSITSPIPKKRKKEKLKRRD

SEQ ID NO: 2749 - protein, 13 aa, Canis lupus familiaris
NSETTGRHNYFKK

SEQ ID NO: 2750 - protein, 15 aa, Canis lupus familiaris
NSFMKTRVNAVDLLT

SEQ ID NO: 2751 - protein, 19 aa, Canis lupus familiaris
NSFSNVDLQNGKSKLFVIF

SEQ ID NO: 2752 - protein, 11 aa, Canis lupus familiaris
NSFYCLEESNR

SEQ ID NO: 2753 - protein, 8 aa, Canis lupus familiaris
NSGDQERL

SEQ ID NO: 2754 - protein, 61 aa, Canis lupus familiaris
NSGEVLWAAGFSTGQPPRSKGIRVSREQDAADLPHRLLQRGEWHHYVPQGLPGLLPGCGPR

SEQ ID NO: 2755 - protein, 76 aa, Canis lupus familiaris
NSGHLLFPSNCGESLLWPKHIYLYVFHFLPQCGAGPSSFCIQQYSNTHVEPSHLQPEEQRGGGSSQEAYGEMCDIL

SEQ ID NO: 2756 - protein, 8 aa, Canis lupus familiaris
NSGSRATS

SEQ ID NO: 2757 - protein, 36 aa, Canis lupus familiaris
NSHRREALCVSGLWESICSELLPHTASESSHWRETI

SEQ ID NO: 2758 - protein, 8 aa, Canis lupus familiaris
NSHRSKAI

SEQ ID NO: 2759 - protein, 16 aa, Canis lupus familiaris
NSHSLGKDLAPRPRSL

SEQ ID NO: 2760 - protein, 16 aa, Canis lupus familiaris
NSHWGRGLKCPGWRGG

SEQ ID NO: 2761 - protein, 8 aa, Canis lupus familiaris
NSHWRKTL

SEQ ID NO: 2762 - protein, 9 aa, Canis lupus familiaris
NSIDEWRRS

SEQ ID NO: 2763 - protein, 13 aa, Canis lupus familiaris
NSIQDQLDGSPGS

SEQ ID NO: 2764 - protein, 14 aa, Canis lupus familiaris
NSIQRWQHNDGGCH

SEQ ID NO: 2765 - protein, 24 aa, Canis lupus familiaris
NSIRNTEVLFQTFLMEQLLVQCSV

SEQ ID NO: 2766 - protein, 37 aa, Canis lupus familiaris
NSITKILSNYLLLKRRQQQDIKYLLWNFVHVEVYILF

SEQ ID NO: 2767 - protein, 10 aa, Canis lupus familiaris
NSKCLVLERH

SEQ ID NO: 2768 - protein, 20 aa, Canis lupus familiaris
NSKGVDKVWYNTCGVAHSCG

SEQ ID NO: 2769 - protein, 13 aa, Canis lupus familiaris
NSKLFYFSGQSEY

SEQ ID NO: 2770 - protein, 26 aa, Canis lupus familiaris
NSKLMPERKSINAMNVGSPSVRSLSS

SEQ ID NO: 2771 - protein, 8 aa, Canis lupus familiaris
NSKRKDYT

SEQ ID NO: 2772 - protein, 21 aa, Canis lupus familiaris
NSKSNIMLVALPRIQLKWHSG

SEQ ID NO: 2773 - protein, 9 aa, Canis lupus familiaris
NSKSPVKSH

SEQ ID NO: 2774 - protein, 12 aa, Canis lupus familiaris
NSKSSWSVRCTS

SEQ ID NO: 2775 - protein, 8 aa, Canis lupus familiaris
NSKWRPEA

SEQ ID NO: 2776 - protein, 9 aa, Canis lupus familiaris
NSLCCEIPE

SEQ ID NO: 2777 - protein, 17 aa, Canis lupus familiaris
NSLFIQFMVLEKAMEMI

SEQ ID NO: 2778 - protein, 8 aa, Canis lupus familiaris
NSLHRYIW

SEQ ID NO: 2779 - protein, 12 aa, Canis lupus familiaris
NSLLPTPTENFK

SEQ ID NO: 2780 - protein, 26 aa, Canis lupus familiaris
NSLPQLWEWPPYCPCDHRRRSLYLGS

SEQ ID NO: 2781 - protein, 9 aa, Canis lupus familiaris
NSMKVESSK

SEQ ID NO: 2782 - protein, 33 aa, Canis lupus familiaris
NSPLCPHPSCQSLCGLPTCPQSYYLWCEDKADS

SEQ ID NO: 2783 - protein, 17 aa, Canis lupus familiaris
NSPLEVGAVTWQIKKMN

SEQ ID NO: 2784 - protein, 75 aa, Canis lupus familiaris
NSPMYKPMCLCKSRDLCWLPVLQRAVSSVLLLYVMCVRSCIVCPVTLAATTKNFFAPTRSPTTSSCRRWRCCVSW

SEQ ID NO: 2785 - protein, 8 aa, Canis lupus familiaris
NSQECSNW

SEQ ID NO: 2786 - protein, 39 aa, Canis lupus familiaris
NSQQTSARNTYLRAAEYFWNFCPSQSRSSRASEYLRQFS

SEQ ID NO: 2787 - protein, 19 aa, Canis lupus familiaris
NSRENKRERTATEEKARRN

SEQ ID NO: 2788 - protein, 17 aa, Canis lupus familiaris
NSRNHQQPTARNLISAE

SEQ ID NO: 2789 - protein, 11 aa, Canis lupus familiaris
NSRTMTHLEGV

SEQ ID NO: 2790 - protein, 12 aa, Canis lupus familiaris
NSRTWITSPGSI

SEQ ID NO: 2791 - protein, 12 aa, Canis lupus familiaris
NSSFFLMVIVLI

SEQ ID NO: 2792 - protein, 35 aa, Canis lupus familiaris
NSSFGGLPGDLEVLAWCGGGGAQGHSISGLTGTPL

SEQ ID NO: 2793 - protein, 12 aa, Canis lupus familiaris
NSSKPATSKSHL

SEQ ID NO: 2794 - protein, 20 aa, Canis lupus familiaris
NSSLLCRAWPVLCFPSNRCS

SEQ ID NO: 2795 - protein, 25 aa, Canis lupus familiaris
NSSPCWYLGQQRTPSAGCWDSHRQN

SEQ ID NO: 2796 - protein, 14 aa, Canis lupus familiaris
NSSRIESILELVVF

SEQ ID NO: 2797 - protein, 21 aa, Canis lupus familiaris
NSSSVPYSYCQSPKCLKQLLS

SEQ ID NO: 2798 - protein, 58 aa, Canis lupus familiaris
NSSVLSAQPLMGFHLTRRTWWRGLSASTSLLQSLEQCLLRWWSTEQTLSCTKMTFLRN

SEQ ID NO: 2799 - protein, 12 aa, Canis lupus familiaris
NSSWCSENSNCY

SEQ ID NO: 2800 - protein, 8 aa, Canis lupus familiaris
NSSWGEAL

SEQ ID NO: 2801 - protein, 47 aa, Canis lupus familiaris
NSTASFVPVMHKTQGSQARSGGLSVTVFCRVWRTQPTNGGHWSRSHS

SEQ ID NO: 2802 - protein, 25 aa, Canis lupus familiaris
NSTERKTERHTMQWRGIERRKSMLE

SEQ ID NO: 2803 - protein, 44 aa, Canis lupus familiaris
NSVRTPTLLNIGEPTQVSNHILVACAEETSAGDQAFLDTRNSTA

SEQ ID NO: 2804 - protein, 25 aa, Canis lupus familiaris
NSWAILGSLPVHAPSPGFIWYRARI

SEQ ID NO: 2805 - protein, 14 aa, Canis lupus familiaris
NSWTSIWHSDLEGS

SEQ ID NO: 2806 - protein, 22 aa, Canis lupus familiaris
NSYGSFKLCGESRWKKRLLEDG

SEQ ID NO: 2807 - protein, 11 aa, Canis lupus familiaris
NSYRGKTLWMQ

SEQ ID NO: 2808 - protein, 9 aa, Canis lupus familiaris
NSYRNDDRD

SEQ ID NO: 2809 - protein, 14 aa, Canis lupus familiaris
NSYTQGEPPQSACG

SEQ ID NO: 2810 - protein, 23 aa, Canis lupus familiaris
NTAKQNRESRSGSLQKRHSTATK

SEQ ID NO: 2811 - protein, 34 aa, Canis lupus familiaris
NTAKWNIKLKHFLGKPMASCIGREKIVQQKTSPI

SEQ ID NO: 2812 - protein, 16 aa, Canis lupus familiaris
NTCASKRGCCWGKPQG

SEQ ID NO: 2813 - protein, 13 aa, Canis lupus familiaris
NTCHRFRREIRYG

SEQ ID NO: 2814 - protein, 9 aa, Canis lupus familiaris
NTEGAFFRL

SEQ ID NO: 2815 - protein, 34 aa, Canis lupus familiaris
NTGGNGEVRCQQLFNLVPGFRLPIQVFVYLLPRN

SEQ ID NO: 2816 - protein, 60 aa, Canis lupus familiaris
NTGGRKAPATSKPTGSPAPLKNKKKTLSLSLCPSLARRGTLKPPHMKSGMRGSKPSRARS

SEQ ID NO: 2817 - protein, 28 aa, Canis lupus familiaris
NTGGRKAPATSKPTGSPAPLKPNARLGN

SEQ ID NO: 2818 - protein, 16 aa, Canis lupus familiaris
NTGGVNSVCQQTKSCI

SEQ ID NO: 2819 - protein, 15 aa, Canis lupus familiaris
NTGRYLLSPLCRRAA

SEQ ID NO: 2820 - protein, 16 aa, Canis lupus familiaris
NTGSCSRVIKVPIRSS

SEQ ID NO: 2821 - protein, 20 aa, Canis lupus familiaris
NTGSIGENGRYYSSTNQIQR

SEQ ID NO: 2822 - protein, 17 aa, Canis lupus familiaris
NTGVKLKSFFIRPRTSS

SEQ ID NO: 2823 - protein, 34 aa, Canis lupus familiaris
NTHLQPVHCFLETKLCSTRRMKVAYGKRSLVQEA

SEQ ID NO: 2824 - protein, 24 aa, Canis lupus familiaris
NTIYLGMKFRVVVMPWTDVSMNMP

SEQ ID NO: 2825 - protein, 14 aa, Canis lupus familiaris
NTKAPRLLNKGPNP

SEQ ID NO: 2826 - protein, 9 aa, Canis lupus familiaris
NTKASGEGT

SEQ ID NO: 2827 - protein, 8 aa, Canis lupus familiaris
NTKFFTFC

SEQ ID NO: 2828 - protein, 24 aa, Canis lupus familiaris
NTKGMRTRRNHISPPTLVFNERVY

SEQ ID NO: 2829 - protein, 14 aa, Canis lupus familiaris
NTKIPTEESSSGKT

SEQ ID NO: 2830 - protein, 27 aa, Canis lupus familiaris
NTKMKAIMPYVTWRVVGKSSRRKKQRV

SEQ ID NO: 2831 - skipped

SEQ ID NO: 2832 - protein, 8 aa, Canis lupus familiaris
NTPAVESI

SEQ ID NO: 2833 - protein, 15 aa, Canis lupus familiaris
NTPCKDQQTKNQREC

SEQ ID NO: 2834 - protein, 37 aa, Canis lupus familiaris
NTPGWQERSQQGEPGAQWQHPERWVPRLGSPPAQLQH

SEQ ID NO: 2835 - protein, 18 aa, Canis lupus familiaris
NTQKMQKGNNLKKRFKVL

SEQ ID NO: 2836 - protein, 31 aa, Canis lupus familiaris
NTQPSLSKGSSEEGRKEKDHKGNSDSQWSPG

SEQ ID NO: 2837 - protein, 17 aa, Canis lupus familiaris
NTRETRQHSCLAYQIPR

SEQ ID NO: 2838 - skipped

SEQ ID NO: 2839 - protein, 8 aa, Canis lupus familiaris
NTSCESNI

SEQ ID NO: 2840 - protein, 11 aa, Canis lupus familiaris
NTSKSMEKRNF

SEQ ID NO: 2841 - protein, 10 aa, Canis lupus familiaris
NTSKTNKNKL

SEQ ID NO: 2842 - protein, 17 aa, Canis lupus familiaris
NTSQQQKCPRGQGDLPA

SEQ ID NO: 2843 - protein, 14 aa, Canis lupus familiaris
NTSVQIVTLQLTRK

SEQ ID NO: 2844 - protein, 12 aa, Canis lupus familiaris
NTSYCKKRRSRF

SEQ ID NO: 2845 - skipped

SEQ ID NO: 2846 - protein, 19 aa, Canis lupus familiaris
NTTFNKARKTLVFYQETRL

SEQ ID NO: 2847 - protein, 19 aa, Canis lupus familiaris
NTVPGTPETGLPKDRICWA

SEQ ID NO: 2848 - protein, 12 aa, Canis lupus familiaris
NTVRMLVFILKL

SEQ ID NO: 2849 - protein, 9 aa, Canis lupus familiaris
NTWKQATPS

SEQ ID NO: 2850 - protein, 8 aa, Canis lupus familiaris
NTWMVPTF

SEQ ID NO: 2851 - protein, 32 aa, Canis lupus familiaris
NTWNTCIHHHVLIHLVVLLDLINEKVTFSKNL

SEQ ID NO: 2852 - protein, 12 aa, Canis lupus familiaris
NTYSFCKRRWNL

SEQ ID NO: 2853 - protein, 14 aa, Canis lupus familiaris
NVAIHVRLIVDLHS

SEQ ID NO: 2854 - protein, 14 aa, Canis lupus familiaris
NVECGICLTGTYKI

SEQ ID NO: 2855 - protein, 23 aa, Canis lupus familiaris
NVEGCIQFTRLFGSLEQPSWKSA

SEQ ID NO: 2856 - protein, 16 aa, Canis lupus familiaris
NVFHSTWCCWCHHKIQ

SEQ ID NO: 2857 - protein, 11 aa, Canis lupus familiaris
NVFVVYHENHL

SEQ ID NO: 2858 - skipped

SEQ ID NO: 2859 - protein, 11 aa, Canis lupus familiaris
NVKCIGHSGGC

SEQ ID NO: 2860 - protein, 12 aa, Canis lupus familiaris
NVKISSKQLVVY

SEQ ID NO: 2861 - protein, 21 aa, Canis lupus familiaris
NVKRLGIKMGKQGITNEGGYL

SEQ ID NO: 2862 - protein, 13 aa, Canis lupus familiaris
NVLCPPLECRHNW

SEQ ID NO: 2863 - skipped

SEQ ID NO: 2864 - protein, 56 aa, Canis lupus familiaris
NVLPRSTRAVIPRRLQWHIQVNGLMKKRSQVKQICSMKMVLFFMKMEVQTSMKSSF

SEQ ID NO: 2865 - protein, 27 aa, Canis lupus familiaris
NVLPTIFCHLPFYLWLHYCGNYPPGYL

SEQ ID NO: 2866 - protein, 25 aa, Canis lupus familiaris
NVLYYSVLEMPSIYIYQVLSQKSWI

SEQ ID NO: 2867 - protein, 11 aa, Canis lupus familiaris
NVPPAQLCFSL

SEQ ID NO: 2868 - protein, 9 aa, Canis lupus familiaris
NVPWLYMSV

SEQ ID NO: 2869 - protein, 12 aa, Canis lupus familiaris
NVQMLFSGKILR

SEQ ID NO: 2870 - protein, 35 aa, Canis lupus familiaris
NVRENDLRNLWLKILYGLHHLREMRTSLIFLMGEV

SEQ ID NO: 2871 - protein, 19 aa, Canis lupus familiaris
NVREQRQEWQEKQQEQEKF

SEQ ID NO: 2872 - skipped

SEQ ID NO: 2873 - protein, 27 aa, Canis lupus familiaris
NVSSTLVFLGHGGRCENSRHQKSQPSP

SEQ ID NO: 2874 - skipped

SEQ ID NO: 2875 - protein, 13 aa, Canis lupus familiaris
NVVKETIIANRTN

SEQ ID NO: 2876 - protein, 9 aa, Canis lupus familiaris
NVVTWNVKL

SEQ ID NO: 2877 - protein, 30 aa, Canis lupus familiaris
NVWQRQTFRPEQCGKLNKQKKQKIHFIEKA

SEQ ID NO: 2878 - protein, 8 aa, Canis lupus familiaris
NVWRPEWL

SEQ ID NO: 2879 - protein, 13 aa, Canis lupus familiaris
NWARTEGTSTCEE

SEQ ID NO: 2880 - protein, 10 aa, Canis lupus familiaris
NWEGTAIKKI

SEQ ID NO: 2881 - protein, 40 aa, Canis lupus familiaris
NWESIFYYKQTSCPYTSTHKYPSKRRNHTLHSSSVSTKDS

SEQ ID NO: 2882 - protein, 37 aa, Canis lupus familiaris
NWGDAAASCPDSSEGKRGPRGIGVRSDEAQQRGRDRF

SEQ ID NO: 2883 - skipped

SEQ ID NO: 2884 - protein, 12 aa, Canis lupus familiaris
NWGRSWLLPKTD

SEQ ID NO: 2885 - protein, 24 aa, Canis lupus familiaris
NWILSKVRKLLQDVMKMAFIFQGL

SEQ ID NO: 2886 - protein, 12 aa, Canis lupus familiaris
NWKPSTRSWRSD

SEQ ID NO: 2887 - skipped

SEQ ID NO: 2888 - protein, 8 aa, Canis lupus familiaris
NWKYRKCI

SEQ ID NO: 2889 - protein, 11 aa, Canis lupus familiaris
NWPPAQSARKQ

SEQ ID NO: 2890 - protein, 8 aa, Canis lupus familiaris
NWRDRKRV

SEQ ID NO: 2891 - protein, 30 aa, Canis lupus familiaris
NWRKIEFSTIIRNRSFKQRRLSPCRCHKYM

SEQ ID NO: 2892 - protein, 9 aa, Canis lupus familiaris
NWSKSTKAN

SEQ ID NO: 2893 - protein, 21 aa, Canis lupus familiaris
NWSSQVGCPKWTLPLSTASAR

SEQ ID NO: 2894 - protein, 15 aa, Canis lupus familiaris
NWTPLFCMKQNFGIR

SEQ ID NO: 2895 - protein, 20 aa, Canis lupus familiaris
NWVLHYRMKRKRKEKTKKNT

SEQ ID NO: 2896 - protein, 13 aa, Canis lupus familiaris
NWVRFQFEKRKLL

SEQ ID NO: 2897 - protein, 11 aa, Canis lupus familiaris
NYCIVHYAKWL

SEQ ID NO: 2898 - protein, 18 aa, Canis lupus familiaris
NYKEKQWTINENNYPQNK

SEQ ID NO: 2899 - protein, 10 aa, Canis lupus familiaris
NYKKSTYLLL

SEQ ID NO: 2900 - protein, 38 aa, Canis lupus familiaris
NYKPNPGTSDQDPQLSGNPAVFYAREVAGASGREGEAE

SEQ ID NO: 2901 - protein, 17 aa, Canis lupus familiaris
NYLDTSRFSVGTGHKRI

SEQ ID NO: 2902 - protein, 9 aa, Canis lupus familiaris
NYPASVTGS

SEQ ID NO: 2903 - protein, 39 aa, Canis lupus familiaris
NYPRICVSLPVCCDVCYICKISSKSGCWWYIFRPNCAVG

SEQ ID NO: 2904 - protein, 13 aa, Canis lupus familiaris
NYQEPKGYSAPSL

SEQ ID NO: 2905 - protein, 15 aa, Canis lupus familiaris
NYQGDDESVRYRQFS

SEQ ID NO: 2906 - protein, 8 aa, Canis lupus familiaris
NYRENPKL

SEQ ID NO: 2907 - protein, 8 aa, Canis lupus familiaris
NYRRGRLI

SEQ ID NO: 2908 - protein, 15 aa, Canis lupus familiaris
NYRSAGIKSLAMEFW

SEQ ID NO: 2909 - protein, 16 aa, Canis lupus familiaris
NYSLMDVQPSRKLLPT

SEQ ID NO: 2910 - protein, 22 aa, Canis lupus familiaris
NYSRAPLPDPLTQVNHLAAPLP

SEQ ID NO: 2911 - protein, 16 aa, Canis lupus familiaris
NYSTVHFKRFHRSDSY

SEQ ID NO: 2912 - protein, 16 aa, Canis lupus familiaris
NYSVPKLYRYLWVSLT

SEQ ID NO: 2913 - protein, 58 aa, Canis lupus familiaris
NYTICEWKGRPESSAQQLQPEGSAIEGPALLGEGCASDHRCEIAGCRGLLLLDRLWRC

SEQ ID NO: 2914 - protein, 44 aa, Canis lupus familiaris
NYVIHHIQWQRDPILLLARNQPQIQELLVLHPNKLITSWEKWRI

SEQ ID NO: 2915 - protein, 44 aa, Canis lupus familiaris
RAEQAVLHSAISHLPWHRRNESHRLPTECLQPSGVWIPETDVFF

SEQ ID NO: 2916 - protein, 23 aa, Canis lupus familiaris
RAETKGQTIRDRLFSKIGQQSVL

SEQ ID NO: 2917 - protein, 25 aa, Canis lupus familiaris
RANCNQCRGSPAAKQGSGDPKYGPS

SEQ ID NO: 2918 - protein, 21 aa, Canis lupus familiaris
RAVSCLKKPVYRNMVPTKHKS

SEQ ID NO: 2919 - protein, 31 aa, Canis lupus familiaris
RDFGGHKNPKSGLHRKAEERLPRRSKYHGTI

SEQ ID NO: 2920 - protein, 36 aa, Canis lupus familiaris
RECEHHLWSFITDYRSKRWIGNSRDRRPFTKPEPRK

SEQ ID NO: 2921 - protein, 9 aa, Canis lupus familiaris
REECRGART

SEQ ID NO: 2922 - protein, 14 aa, Canis lupus familiaris
REISEERHHCITQL

SEQ ID NO: 2923 - protein, 10 aa, Canis lupus familiaris
REQICSRQTF

SEQ ID NO: 2924 - protein, 11 aa, Canis lupus familiaris
RETNEDLRKQV

SEQ ID NO: 2925 - protein, 18 aa, Canis lupus familiaris
RETRGRSKEIETQRHKKF

SEQ ID NO: 2926 - protein, 11 aa, Canis lupus familiaris
RFANGYSPQNM

SEQ ID NO: 2927 - protein, 19 aa, Canis lupus familiaris
RGDNKGGRAREEVFQKAKS

SEQ ID NO: 2928 - protein, 13 aa, Canis lupus familiaris
RGRTAERDEAEAG

SEQ ID NO: 2929 - protein, 11 aa, Canis lupus familiaris
RGRTYTRNGKI

SEQ ID NO: 2930 - protein, 22 aa, Canis lupus familiaris
RGTETTVPITVPIISAAGLMSV

SEQ ID NO: 2931 - protein, 10 aa, Canis lupus familiaris
RIFRQAPCRR

SEQ ID NO: 2932 - protein, 11 aa, Canis lupus familiaris
RILDLAWRKGS

SEQ ID NO: 2933 - protein, 34 aa, Canis lupus familiaris
RISQGAKEKLPRRKEKSHKGVTQYNHRSFCYCYG

SEQ ID NO: 2934 - protein, 10 aa, Canis lupus familiaris
RKCQQKRSNI

SEQ ID NO: 2935 - protein, 20 aa, Canis lupus familiaris
RKDCRTTSRRERRGGWEEQS

SEQ ID NO: 2936 - protein, 39 aa, Canis lupus familiaris
RKDRESKFREWGRKLCVKFSFHILYCCIKYSCSCQPISS

SEQ ID NO: 2937 - protein, 18 aa, Canis lupus familiaris
RKDRMAGFTHWKCSELTS

SEQ ID NO: 2938 - skipped

SEQ ID NO: 2939 - protein, 10 aa, Canis lupus familiaris
RKGEEKEKTQ

SEQ ID NO: 2940 - protein, 8 aa, Canis lupus familiaris
RKGIRTIR

SEQ ID NO: 2941-2942 - skipped (2 entries)

SEQ ID NO: 2943 - protein, 21 aa, Canis lupus familiaris
RKKRKEGQNFQQEKFPSPQDR

SEQ ID NO: 2944 - skipped

SEQ ID NO: 2945 - protein, 30 aa, Canis lupus familiaris
RKQRGYNYVETNTDGSCSGNHGSDLQKCHE

SEQ ID NO: 2946 - protein, 14 aa, Canis lupus familiaris
RKRERKGRKWKRRR

SEQ ID NO: 2947 - protein, 11 aa, Canis lupus familiaris
RKSKAEPGTGV

SEQ ID NO: 2948 - protein, 11 aa, Canis lupus familiaris
RKTPCKCQVYR

SEQ ID NO: 2949 - protein, 22 aa, Canis lupus familiaris
RKTRVAFKAEGEYTAFPSRGRG

SEQ ID NO: 2950 - protein, 38 aa, Canis lupus familiaris
RLPRGLQFGTICNSIFIEGDLESAAVSPEFSGMCHGNY

SEQ ID NO: 2951 - protein, 8 aa, Canis lupus familiaris
RLSLEQGV

SEQ ID NO: 2952 - protein, 12 aa, Canis lupus familiaris
RLYQKLDKTQKT

SEQ ID NO: 2953 - protein, 8 aa, Canis lupus familiaris
RMGRTVQE

SEQ ID NO: 2954 - protein, 13 aa, Canis lupus familiaris
RNGNRQTASWEDS

SEQ ID NO: 2955 - protein, 13 aa, Canis lupus familiaris
RNPQREEVDMCFL

SEQ ID NO: 2956 - protein, 9 aa, Canis lupus familiaris
RNQHTRSYF

SEQ ID NO: 2957 - protein, 14 aa, Canis lupus familiaris
RNQWFTEEITRQGS

SEQ ID NO: 2958 - protein, 15 aa, Canis lupus familiaris
RNRDERHVGHAIKVQ

SEQ ID NO: 2959 - protein, 16 aa, Canis lupus familiaris
RNRKLCRKVANIPLLL

SEQ ID NO: 2960 - protein, 19 aa, Canis lupus familiaris
RNSIQFRAEVDGSEMQPQE

SEQ ID NO: 2961 - protein, 19 aa, Canis lupus familiaris
RPGALEEIENAKQAKHPGG

SEQ ID NO: 2962 - protein, 10 aa, Canis lupus familiaris
RPIYPKGGSQ

SEQ ID NO: 2963 - protein, 12 aa, Canis lupus familiaris
RPNGKATFRCKF

SEQ ID NO: 2964 - skipped

SEQ ID NO: 2965 - protein, 25 aa, Canis lupus familiaris
RQLPVGCTELYRREVSDVETRSRLH

SEQ ID NO: 2966 - protein, 16 aa, Canis lupus familiaris
RQRKTVEKFIFYLRRQ

SEQ ID NO: 2967 - protein, 10 aa, Canis lupus familiaris
RRDEQNKNIS

SEQ ID NO: 2968 - protein, 24 aa, Canis lupus familiaris
RRGGKPTSKKNLYLEYKGGSKASI

SEQ ID NO: 2969 - protein, 22 aa, Canis lupus familiaris
RRGSWGQISYNCCRGETSQHDS

SEQ ID NO: 2970 - protein, 11 aa, Canis lupus familiaris
RRIMDSRNKRN

SEQ ID NO: 2971 - skipped

SEQ ID NO: 2972 - protein, 15 aa, Canis lupus familiaris
RRKEMGSTKISASQI

SEQ ID NO: 2973 - protein, 23 aa, Canis lupus familiaris
RRKHGWFSDTTYPTNWPSQYSNP

SEQ ID NO: 2974 - protein, 18 aa, Canis lupus familiaris
RRKSCRLVFSGHHKVRND

SEQ ID NO: 2975 - protein, 21 aa, Canis lupus familiaris
RRLEGSGSNENPSFHVWSGGA

SEQ ID NO: 2976 - protein, 50 aa, Canis lupus familiaris
RRNACRQRRVHFRWYRTCPSAICLIVCFGKDRRETAGASHFYFSGVWEES

SEQ ID NO: 2977 - protein, 65 aa, Canis lupus familiaris
RRNSGENGARVGGTNQRTESHPGGVDDLQSDVIRLEPEVGRIAETLLSAGRAERSRDSFKNRCRK

SEQ ID NO: 2978 - protein, 30 aa, Canis lupus familiaris
RRQGTEEKRRRKGEGGGRIKEKRGRRKKET

SEQ ID NO: 2979 - protein, 11 aa, Canis lupus familiaris
RRSKKCGRIIY

SEQ ID NO: 2980 - protein, 21 aa, Canis lupus familiaris
RRTSQIGDIGSSHGWSYSKRL

SEQ ID NO: 2981 - protein, 12 aa, Canis lupus familiaris
RRTYWNCIQQTD

SEQ ID NO: 2982 - protein, 17 aa, Canis lupus familiaris
RRYHSASSRLFETHGAQ

SEQ ID NO: 2983 - protein, 23 aa, Canis lupus familiaris
RSEGTERTQGEKRAQGTQDPESP

SEQ ID NO: 2984 - protein, 8 aa, Canis lupus familiaris
RSFHPFHL

SEQ ID NO: 2985 - protein, 12 aa, Canis lupus familiaris
RSFPKRSDTLPR

SEQ ID NO: 2986 - protein, 13 aa, Canis lupus familiaris
RSGRHGIQSRKCL

SEQ ID NO: 2987 - protein, 11 aa, Canis lupus familiaris
RSLFSSRHILL

SEQ ID NO: 2988 - protein, 26 aa, Canis lupus familiaris
RSNRNASFWAAGKSLCPNGSIFKVGF

SEQ ID NO: 2989 - protein, 10 aa, Canis lupus familiaris
RSPCPFKNGG

SEQ ID NO: 2990 - protein, 74 aa, Canis lupus familiaris
RSPDQARRRRPIWRASSRGAPSWRRSLLSRGCAANLVQQSPATAQAQQRGPATGGPASQSEVPGGLRDSCQRLL

SEQ ID NO: 2991 - protein, 61 aa, Canis lupus familiaris
RSPDQARRRRPIWRASSRGAPSWRRSLLSRGCAANLVQQSPATAQVQGTNVQFPRWSPVPY

SEQ ID NO: 2992 - protein, 8 aa, Canis lupus familiaris
RSPTATTM

SEQ ID NO: 2993 - protein, 12 aa, Canis lupus familiaris
RSQSKQIWRYLG

SEQ ID NO: 2994 - protein, 10 aa, Canis lupus familiaris
RSRDCPGEGG

SEQ ID NO: 2995 - protein, 19 aa, Canis lupus familiaris
RSRPLPSRVRGTFRKHGDT

SEQ ID NO: 2996 - protein, 19 aa, Canis lupus familiaris
RSSEFQFRKDQYCLWILET

SEQ ID NO: 2997 - protein, 8 aa, Canis lupus familiaris
RSSERSCQ

SEQ ID NO: 2998 - protein, 18 aa, Canis lupus familiaris
RSSETFWCRRVKEEKSKS

SEQ ID NO: 2999 - protein, 11 aa, Canis lupus familiaris
RSSGDSWFNGT

SEQ ID NO: 3000 - protein, 9 aa, Canis lupus familiaris
RSSKMFSRY

SEQ ID NO: 3001 - protein, 28 aa, Canis lupus familiaris
RSSSERKKGLPGSWQEDLRGRYSKEKEA

SEQ ID NO: 3002 - protein, 71 aa, Canis lupus familiaris
RSYTDHSKVLQSVSERKDGAHQLFAETGCSHSTADCFQEDESSQFIQTKQSCLCSSVLLEDETRQISISKP

SEQ ID NO: 3003 - protein, 14 aa, Canis lupus familiaris
RTALIYSTTGWDDL

SEQ ID NO: 3004 - protein, 29 aa, Canis lupus familiaris
RTCKCGIHWACRCWQVNHWRTNNVFDRNG

SEQ ID NO: 3005 - protein, 24 aa, Canis lupus familiaris
RTEYVFLFQTVMCDQLRRHQLLEF

SEQ ID NO: 3006 - protein, 13 aa, Canis lupus familiaris
RTILDHTRSLSQR

SEQ ID NO: 3007 - protein, 36 aa, Canis lupus familiaris
RTLHSHVDKNFAVCCCGHFFVFGLSSYGNQPRKSVQ

SEQ ID NO: 3008 - protein, 13 aa, Canis lupus familiaris
RTRSLCQNRTYPW

SEQ ID NO: 3009 - protein, 8 aa, Canis lupus familiaris
RVKDTCAR

SEQ ID NO: 3010 - protein, 21 aa, Canis lupus familiaris
RVPECYYLQISFCLVPTSFPL

SEQ ID NO: 3011 - protein, 19 aa, Canis lupus familiaris
RVSRPSPKFSCEENAVSPD

SEQ ID NO: 3012 - protein, 32 aa, Canis lupus familiaris
RVYSELENQKAAKEGGNFQVKGKSREPISTLS

SEQ ID NO: 3013 - protein, 29 aa, Canis lupus familiaris
RWFDISLFRSFRKHQKQSTDISSSKVQIN

SEQ ID NO: 3014 - protein, 21 aa, Canis lupus familiaris
RWQEEGFFFPDSVSPFQGEFK

SEQ ID NO: 3015 - protein, 8 aa, Canis lupus familiaris
RWTHADNS

SEQ ID NO: 3016 - protein, 45 aa, Canis lupus familiaris
RWVHEFISSITEESDFFRNSGRKIQEKSFADTRQSISKIQAYTSS

SEQ ID NO: 3017 - protein, 21 aa, Canis lupus familiaris
RYPPSYGPDGKPRPRFNNVQL

SEQ ID NO: 3018 - protein, 33 aa, Canis lupus familiaris
RYQPRGSQNGHREPKNQCGRCRRKLKRSQTQDA

SEQ ID NO: 3019 - protein, 13 aa, Canis lupus familiaris
RYRREIRKLSTVH

SEQ ID NO: 3020 - protein, 8 aa, Canis lupus familiaris
RYRRFQRC

SEQ ID NO: 3021 - protein, 13 aa, Canis lupus familiaris
SCRDHYHPRHILL

SEQ ID NO: 3022 - protein, 9 aa, Canis lupus familiaris
SCSDTWYWN

SEQ ID NO: 3023 - protein, 8 aa, Canis lupus familiaris
SDYEIRYN

SEQ ID NO: 3024 - protein, 13 aa, Canis lupus familiaris
SEERLTINRLQYY

SEQ ID NO: 3025 - protein, 9 aa, Canis lupus familiaris
SEHLQFSGI

SEQ ID NO: 3026 - protein, 43 aa, Canis lupus familiaris
SEIYSWISTECHGRNDGQTAILVYIKAKSLGCSNPCISSQDKR

SEQ ID NO: 3027 - protein, 16 aa, Canis lupus familiaris
SFEEKQWGTKWILCGN

SEQ ID NO: 3028 - protein, 27 aa, Canis lupus familiaris
SFFKSSRQSSDKNGKGYTGGSKSSIYC

SEQ ID NO: 3029 - protein, 35 aa, Canis lupus familiaris
SFLHLFFTHACCFHYIRQLYFHLYQAFGQRRGGYQ

SEQ ID NO: 3030 - protein, 16 aa, Canis lupus familiaris
SFLQHWHHVPPGDKPL

SEQ ID NO: 3031 - protein, 38 aa, Canis lupus familiaris
SFQFCHLQGDSLCSLGSWNTTCTFWIFCALCSLDETRE

SEQ ID NO: 3032 - protein, 8 aa, Canis lupus familiaris
SFSFFRGH

SEQ ID NO: 3033 - protein, 19 aa, Canis lupus familiaris
SFSMGKKFGVSCCYGSPPY

SEQ ID NO: 3034 - protein, 13 aa, Canis lupus familiaris
SGAGTVFWFKRLK

SEQ ID NO: 3035 - skipped

SEQ ID NO: 3036 - protein, 30 aa, Canis lupus familiaris
SGTKQSTGILLWKGCTFRPDTTGYSAEICI

SEQ ID NO: 3037 - protein, 23 aa, Canis lupus familiaris
SIGFPAPEACLRMQSSELGLPMV

SEQ ID NO: 3038 - protein, 14 aa, Canis lupus familiaris
SIRKRRNSSYRGQI

SEQ ID NO: 3039 - protein, 16 aa, Canis lupus familiaris
SIRRCSTTIWACFRIQ

SEQ ID NO: 3040 - protein, 21 aa, Canis lupus familiaris
SISFRNSWIPSDGSKEMLCCL

SEQ ID NO: 3041 - protein, 16 aa, Canis lupus familiaris
SKDVISWSHRGSFEIP

SEQ ID NO: 3042 - protein, 9 aa, Canis lupus familiaris
SKEREEKKE

SEQ ID NO: 3043 - protein, 9 aa, Canis lupus familiaris
SKKDDWSES

SEQ ID NO: 3044 - protein, 8 aa, Canis lupus familiaris
SKSEFTAC

SEQ ID NO: 3045 - protein, 28 aa, Canis lupus familiaris
SLFYMLLSYDCGLTFLWKLYLYVHKSFC

SEQ ID NO: 3046 - protein, 22 aa, Canis lupus familiaris
SLKIYQIENFTRKKNIVSRIMD

SEQ ID NO: 3047 - protein, 26 aa, Canis lupus familiaris
SLLHLWGPSLFCVFILWPPPFHVCAP

SEQ ID NO: 3048 - protein, 8 aa, Canis lupus familiaris
SLSFSLRK

SEQ ID NO: 3049 - protein, 22 aa, Canis lupus familiaris
SLWECGWSAVLDTCYGNILWYQ

SEQ ID NO: 3050 - protein, 9 aa, Canis lupus familiaris
SNHSKRTGA

SEQ ID NO: 3051 - protein, 27 aa, Canis lupus familiaris
SNWVQIISFTIYFLHLISSQSFEGDTL

SEQ ID NO: 3052 - protein, 16 aa, Canis lupus familiaris
SPAKLGAGHWGPSRDP

SEQ ID NO: 3053 - protein, 8 aa, Canis lupus familiaris
SPLCAYPT

SEQ ID NO: 3054 - protein, 9 aa, Canis lupus familiaris
SPPSEGLWV

SEQ ID NO: 3055 - protein, 26 aa, Canis lupus familiaris
SQKTHDLCGCCWTSIWSRRRHLTLFF

SEQ ID NO: 3056 - protein, 19 aa, Canis lupus familiaris
SQSKGGGFQAAHSSHSSDL

SEQ ID NO: 3057 - protein, 20 aa, Canis lupus familiaris
SQSVWKRRCENELHRSDLYW

SEQ ID NO: 3058 - protein, 15 aa, Canis lupus familiaris
SRGEERMAESTGYSL

SEQ ID NO: 3059 - protein, 15 aa, Canis lupus familiaris
SRGKLSCSSPSGRTS

SEQ ID NO: 3060 - protein, 17 aa, Canis lupus familiaris
SRGKLSCSSPSGRTSYV

SEQ ID NO: 3061 - protein, 52 aa, Canis lupus familiaris
SRSCHTSQESSCHPWQKGSSYTSQKGGCTSQSSSNTWQEGNHTRQGIGSNPW

SEQ ID NO: 3062 - protein, 11 aa, Canis lupus familiaris
SRVTSLGGRRW

SEQ ID NO: 3063 - protein, 14 aa, Canis lupus familiaris
SSGSSQICDFSDDE

SEQ ID NO: 3064 - protein, 19 aa, Canis lupus familiaris
SSPHPQTVAQKAQSTPVNL

SEQ ID NO: 3065 - protein, 8 aa, Canis lupus familiaris
SSQFWKEI

SEQ ID NO: 3066 - protein, 31 aa, Canis lupus familiaris
SSRKDGCHWCRSNRCRIGFSLAETWCRCDSS

SEQ ID NO: 3067 - protein, 8 aa, Canis lupus familiaris
SSSFLRHH

SEQ ID NO: 3068 - protein, 11 aa, Canis lupus familiaris
STERCQKYFFI

SEQ ID NO: 3069 - protein, 19 aa, Canis lupus familiaris
STTSSTRNKEAKASPTNST

SEQ ID NO: 3070 - protein, 29 aa, Canis lupus familiaris
SWGGRICSCRSRLCLQVCGAGKSWRVQTF

SEQ ID NO: 3071 - protein, 12 aa, Canis lupus familiaris
SWPGSRSFSKEH

SEQ ID NO: 3072 - protein, 14 aa, Canis lupus familiaris
SYLRLDKVQGHMST

SEQ ID NO: 3073 - protein, 42 aa, Canis lupus familiaris
TAGLPTAERARGARLRQEAGGDEQPSAAVAEAAPERPQDAGS

SEQ ID NO: 3074 - protein, 24 aa, Canis lupus familiaris
TAIEGKIYQPPGCHTDLPQPLLCF

SEQ ID NO: 3075 - protein, 8 aa, Canis lupus familiaris
TAKRSLWA

SEQ ID NO: 3076 - protein, 10 aa, Canis lupus familiaris
TANSCQRENP

SEQ ID NO: 3077 - protein, 29 aa, Canis lupus familiaris
TAPLEDCQETWRSWPGAEEAGLRATPSQA

SEQ ID NO: 3078 - protein, 10 aa, Canis lupus familiaris
TAQHPSAIII

SEQ ID NO: 3079 - skipped

SEQ ID NO: 3080 - protein, 11 aa, Canis lupus familiaris
TAQKSREEYQH

SEQ ID NO: 3081 - skipped

SEQ ID NO: 3082 - protein, 18 aa, Canis lupus familiaris
TCCTIQSSRCPVFIFIRY

SEQ ID NO: 3083 - protein, 11 aa, Canis lupus familiaris
TCPGDANRRLW

SEQ ID NO: 3084 - protein, 38 aa, Canis lupus familiaris
TCRLCSVKSLQLLSEFWFCKSFFKTQRTKETTINLEYL

SEQ ID NO: 3085 - protein, 13 aa, Canis lupus familiaris
TCSRNQETKYNSV

SEQ ID NO: 3086 - protein, 9 aa, Canis lupus familiaris
TDDSGKPEL

SEQ ID NO: 3087 - protein, 32 aa, Canis lupus familiaris
TDGTSSPEPESPRSSEESSKLFRSLSPGLALA

SEQ ID NO: 3088 - protein, 18 aa, Canis lupus familiaris
TDKISSKTSIYCQKGTAS

SEQ ID NO: 3089 - skipped

SEQ ID NO: 3090 - protein, 14 aa, Canis lupus familiaris
TEEKNRQIWRKNCT

SEQ ID NO: 3091 - protein, 8 aa, Canis lupus familiaris
TEGERRDY

SEQ ID NO: 3092 - protein, 10 aa, Canis lupus familiaris
TEGLWRRGRS

SEQ ID NO: 3093 - protein, 19 aa, Canis lupus familiaris
TEKHFKNRNPESWITFMGR

SEQ ID NO: 3094 - protein, 11 aa, Canis lupus familiaris
TEKNYRENPKL

SEQ ID NO: 3095 - protein, 13 aa, Canis lupus familiaris
TEKRTRRQEIRKY

SEQ ID NO: 3096 - protein, 13 aa, Canis lupus familiaris
TEREPPSLHSTFL

SEQ ID NO: 3097 - protein, 27 aa, Canis lupus familiaris
TESCFSGKDVSERRSGKEVSWRTDRSV

SEQ ID NO: 3098 - protein, 14 aa, Canis lupus familiaris
TFAKSQGESKTGEY

SEQ ID NO: 3099 - protein, 9 aa, Canis lupus familiaris
TFFPGLPGL

SEQ ID NO: 3100 - protein, 13 aa, Canis lupus familiaris
TFLNYTESPGNIA

SEQ ID NO: 3101 - protein, 17 aa, Canis lupus familiaris
TFRQGGRFRASLGAQSN

SEQ ID NO: 3102 - protein, 23 aa, Canis lupus familiaris
TGGEAGYCQRQTDAAGASREPEN

SEQ ID NO: 3103 - protein, 22 aa, Canis lupus familiaris
TGKERKIRGTSKVVKEGTFSSK

SEQ ID NO: 3104 - skipped

SEQ ID NO: 3105 - protein, 19 aa, Canis lupus familiaris
TGNRIYFRRCNVEWLFRIY

SEQ ID NO: 3106 - protein, 25 aa, Canis lupus familiaris
TGPGSESKGLSGVLGPQQPGGSAGV

SEQ ID NO: 3107 - protein, 27 aa, Canis lupus familiaris
TGRFHEHHGCQWRADPRPAGGWTPAGV

SEQ ID NO: 3108 - protein, 12 aa, Canis lupus familiaris
TGSQVQEAGEAM

SEQ ID NO: 3109 - protein, 41 aa, Canis lupus familiaris
TGWGCEYFHHLFHRAFSSDATIHPTHSQASEHPGSQPLHCD

SEQ ID NO: 3110 - protein, 22 aa, Canis lupus familiaris
TGYRIRCFNDHHCWSEVATILF

SEQ ID NO: 3111 - protein, 11 aa, Canis lupus familiaris
THGILAFIIMC

SEQ ID NO: 3112 - protein, 12 aa, Canis lupus familiaris
THGPHRKTHCPQ

SEQ ID NO: 3113 - protein, 28 aa, Canis lupus familiaris
TINTCIYETCIRLRRTLQFCYTVGEHSY

SEQ ID NO: 3114 - protein, 14 aa, Canis lupus familiaris
TIQCQSSIDICGSL

SEQ ID NO: 3115 - protein, 69 aa, Canis lupus familiaris
TKAEEKEATQRELPEERGDLVRGPQAPLPIRATPGRAGPHLWPVHHSCVAVRSWPPLLPGPALTPEATQ

SEQ ID NO: 3116 - protein, 38 aa, Canis lupus familiaris
TKDYTNSPKDDYIDNAQITPYLFSGSHAPNYHQPQPKT

SEQ ID NO: 3117 - protein, 35 aa, Canis lupus familiaris
TKEKGTKLRNAFKKKSMCYHTVEKHQILLLFYVRT

SEQ ID NO: 3118 - protein, 21 aa, Canis lupus familiaris
TKKENFNRNQPKMEFRSRKRR

SEQ ID NO: 3119 - protein, 14 aa, Canis lupus familiaris
TKMVFRMFISSRWQ

SEQ ID NO: 3120 - protein, 12 aa, Canis lupus familiaris
TKNIQKGKKHCS

SEQ ID NO: 3121 - protein, 34 aa, Canis lupus familiaris
TKPWCREVSLFQCHHGRTGNLTQKSEKAKEKVKN

SEQ ID NO: 3122 - protein, 8 aa, Canis lupus familiaris
TKRSVCYF

SEQ ID NO: 3123 - protein, 26 aa, Canis lupus familiaris
TKSFRYKRKSLAYSKSPSCATFRSGR

SEQ ID NO: 3124 - protein, 50 aa, Canis lupus familiaris
TKSMSVLHSTRTNRRCSHNILSLQLSSRCTNKGKYGYQSERTGCHFRRSS

SEQ ID NO: 3125 - protein, 31 aa, Canis lupus familiaris
TLGSRPPRAERGRTSAAVCLLARERRTVGRE

SEQ ID NO: 3126 - protein, 14 aa, Canis lupus familiaris
TLLLRNCKGPFSKN

SEQ ID NO: 3127 - protein, 34 aa, Canis lupus familiaris
TLPTFPESPAAIPTRTTGGPQTPLWLSPASHHPH

SEQ ID NO: 3128 - protein, 8 aa, Canis lupus familiaris
TLQSGISN

SEQ ID NO: 3129 - protein, 11 aa, Canis lupus familiaris
TLSNKTFFCKE

SEQ ID NO: 3130 - protein, 10 aa, Canis lupus familiaris
TMAHLKSESE

SEQ ID NO: 3131 - protein, 16 aa, Canis lupus familiaris
TMSFTIFSGRETQFCF

SEQ ID NO: 3132 - protein, 11 aa, Canis lupus familiaris
TMSKDPEITSY

SEQ ID NO: 3133 - protein, 28 aa, Canis lupus familiaris
TNPTAAVPSFAIPSFSILFCKKAPTVIT

SEQ ID NO: 3134 - protein, 11 aa, Canis lupus familiaris
TNSKWCLALFI

SEQ ID NO: 3135 - protein, 16 aa, Canis lupus familiaris
TNSSPKKEGPKTQTPQ

SEQ ID NO: 3136 - protein, 8 aa, Canis lupus familiaris
TPASCERE

SEQ ID NO: 3137 - protein, 19 aa, Canis lupus familiaris
TPEEEKHQQLQSRRALRHR

SEQ ID NO: 3138 - skipped

SEQ ID NO: 3139 - protein, 13 aa, Canis lupus familiaris
TPETISNQQPEIS

SEQ ID NO: 3140 - protein, 28 aa, Canis lupus familiaris
TPGRTRSTTSQHICGSRRQHLNWIRSLL

SEQ ID NO: 3141 - protein, 20 aa, Canis lupus familiaris
TPISNQCTVSWKQSSALQEE

SEQ ID NO: 3142 - protein, 49 aa, Canis lupus familiaris
TPQMDEKASRCFICFWGEAGYLWPPQHPCPSGATALPPPCLHQSSYHRI

SEQ ID NO: 3143 - protein, 8 aa, Canis lupus familiaris
TPQRRSLC

SEQ ID NO: 3144 - protein, 80 aa, Canis lupus familiaris
TPWGERGGRDDGGGQHRRRHRAAAAAPGAQKTQAPERRWREQRWRTSEAESGAWGRARGRAARDRSRDTQRRARAGARPG

SEQ ID NO: 3145 - protein, 13 aa, Canis lupus familiaris
TQASLWRKETFEM

SEQ ID NO: 3146 - protein, 8 aa, Canis lupus familiaris
TQAVAQEL

SEQ ID NO: 3147 - protein, 25 aa, Canis lupus familiaris
TQGKRPSRWTRWDPAKEDTEEISGK

SEQ ID NO: 3148 - protein, 8 aa, Canis lupus familiaris
TQGRRWAI

SEQ ID NO: 3149 - skipped

SEQ ID NO: 3150 - protein, 12 aa, Canis lupus familiaris
TQSQKYCQIICY

SEQ ID NO: 3151 - protein, 11 aa, Canis lupus familiaris
TQSRASNSLYL

SEQ ID NO: 3152 - protein, 14 aa, Canis lupus familiaris
TQSSTTSCQSYSVE

SEQ ID NO: 3153 - protein, 23 aa, Canis lupus familiaris
TRAFSSVYFSFYKWREVSVFSRF

SEQ ID NO: 3154 - skipped

SEQ ID NO: 3155 - protein, 8 aa, Canis lupus familiaris
TRGGTAQA

SEQ ID NO: 3156 - protein, 37 aa, Canis lupus familiaris
TRLLPAQPLERTKLLPGICRDSCWHPRCLSGPERKTV

SEQ ID NO: 3157 - protein, 10 aa, Canis lupus familiaris
TRRHYNQWSD

SEQ ID NO: 3158 - protein, 9 aa, Canis lupus familiaris
TRRPVSGKA

SEQ ID NO: 3159 - protein, 33 aa, Canis lupus familiaris
TRRYCGQFSCVFCTAHPVSSSRKSTATEASEHS

SEQ ID NO: 3160 - protein, 61 aa, Canis lupus familiaris
TRSRGRGELRRGAGGVPGPAAAAHRVAEGTEPAKGLVRPQRPGLADTHAGQAAPPWARPER

SEQ ID NO: 3161 - skipped

SEQ ID NO: 3162 - protein, 16 aa, Canis lupus familiaris
TSEDRCCEIYAKKPHE

SEQ ID NO: 3163 - protein, 34 aa, Canis lupus familiaris
TSEPDQDPGHLNHPVHLGRLYCICDDPRCHFQIY

SEQ ID NO: 3164 - protein, 18 aa, Canis lupus familiaris
TSHVPQAPCVNSYIYPRD

SEQ ID NO: 3165 - protein, 21 aa, Canis lupus familiaris
TSIQLVCLWNAFPFTWEFFSP

SEQ ID NO: 3166 - protein, 14 aa, Canis lupus familiaris
TSRNPRHAPPTLAT

SEQ ID NO: 3167 - protein, 16 aa, Canis lupus familiaris
TSVLLKEVRGKQYLWY

SEQ ID NO: 3168 - protein, 15 aa, Canis lupus familiaris
TTACLRVPVLFSGNQ

SEQ ID NO: 3169 - protein, 10 aa, Canis lupus familiaris
TTAEPRFQIP

SEQ ID NO: 3170 - protein, 40 aa, Canis lupus familiaris
TTEAGPGRRFPPSTAPGPPRPSPQTPLPGSNPESRSARPG

SEQ ID NO: 3171 - skipped

SEQ ID NO: 3172 - protein, 42 aa, Canis lupus familiaris
TTRRSSGSSCSRICRIKRVQWCWWDRSFLREFFSSIKVELQE

SEQ ID NO: 3173 - protein, 59 aa, Canis lupus familiaris
TTTKATFKAATTYPSTARRGRPATSGIPTIWQWAISLSTATMAGSTQGTTRLWTSASQQ

SEQ ID NO: 3174 - protein, 16 aa, Canis lupus familiaris
TVSPMWICRMENPNYL

SEQ ID NO: 3175 - protein, 12 aa, Canis lupus familiaris
TVYCSECQLQRH

SEQ ID NO: 3176 - protein, 14 aa, Canis lupus familiaris
TWENDGCGKMLHPR

SEQ ID NO: 3177 - protein, 8 aa, Canis lupus familiaris
TWESNDTE

SEQ ID NO: 3178 - protein, 15 aa, Canis lupus familiaris
TWIQFKSQNATDESK

SEQ ID NO: 3179 - protein, 8 aa, Canis lupus familiaris
TWQHLLPL

SEQ ID NO: 3180 - protein, 10 aa, Canis lupus familiaris
TWTHLPENCH

SEQ ID NO: 3181 - protein, 20 aa, Canis lupus familiaris
TYCEQRGAAETSGVCNAGSR

SEQ ID NO: 3182 - protein, 35 aa, Canis lupus familiaris
ICAKEKSKRVKGVGFKDGPESLHLSGFLSHGLSRD

SEQ ID NO: 3183 - protein, 18 aa, Canis lupus familiaris
ICIFTSQVKESNNNMDWS

SEQ ID NO: 3184 - protein, 8 aa, Canis lupus familiaris
ICSGNGFP

SEQ ID NO: 3185 - protein, 32 aa, Canis lupus familiaris
IDPSERSEHFFKDQRDTFYRKDSSAFLRCSCS

SEQ ID NO: 3186 - protein, 20 aa, Canis lupus familiaris
IFNHRSHSFKGTRYLERVEF

SEQ ID NO: 3187 - protein, 10 aa, Canis lupus familiaris
IFRNSHRHPC

SEQ ID NO: 3188 - protein, 28 aa, Canis lupus familiaris
IGERNSGQVPPIGPFHRNGSCQHCGDTF

SEQ ID NO: 3189 - protein, 11 aa, Canis lupus familiaris
IGKNSTAAKTS

SEQ ID NO: 3190 - protein, 12 aa, Canis lupus familiaris
IHESKNQQETLL

SEQ ID NO: 3191 - protein, 9 aa, Canis lupus familiaris
IHRLHPKSR

SEQ ID NO: 3192 - protein, 8 aa, Canis lupus familiaris
IKASVILR

SEQ ID NO: 3193 - protein, 8 aa, Canis lupus familiaris
IKEFRRVS

SEQ ID NO: 3194 - skipped

SEQ ID NO: 3195 - protein, 10 aa, Canis lupus familiaris
IKGDISKSST

SEQ ID NO: 3196 - protein, 8 aa, Canis lupus familiaris
IKLGSEML

SEQ ID NO: 3197 - protein, 9 aa, Canis lupus familiaris
IKVGKKHKR

SEQ ID NO: 3198 - protein, 12 aa, Canis lupus familiaris
ILVRICSGFFII

SEQ ID NO: 3199 - protein, 37 aa, Canis lupus familiaris
INSRKGEGAKKKAQEIPSLWALLRAEKAFVCTRSADV

SEQ ID NO: 3200 - protein, 18 aa, Canis lupus familiaris
INSRKGEGAKKKAQEIPV

SEQ ID NO: 3201 - protein, 31 aa, Canis lupus familiaris
IPLCSFPSCCVFNWECCGGYVGDCDHSDRPE

SEQ ID NO: 3202 - protein, 10 aa, Canis lupus familiaris
IRKLPCSNRS

SEQ ID NO: 3203 - protein, 8 aa, Canis lupus familiaris
IRNRDFPF

SEQ ID NO: 3204 - protein, 20 aa, Canis lupus familiaris
IRSWSACPQEPQKPHSLMGA

SEQ ID NO: 3205 - protein, 16 aa, Canis lupus familiaris
IRTRNSSIRAWWKIEV

SEQ ID NO: 3206 - protein, 18 aa, Canis lupus familiaris
ISAEPACCCADPEVLPEL

SEQ ID NO: 3207 - protein, 11 aa, Canis lupus familiaris
ISEIFIPTWTY

SEQ ID NO: 3208 - protein, 27 aa, Canis lupus familiaris
ISGRDRKKGKINPGECGFASGTYYDWH

SEQ ID NO: 3209 - protein, 25 aa, Canis lupus familiaris
ISKDGCSSCVHQSRRPSDNFRMLPV

SEQ ID NO: 3210 - protein, 10 aa, Canis lupus familiaris
ISNCKAPILL

SEQ ID NO: 3211 - protein, 13 aa, Canis lupus familiaris
ITFQTPEAASLRP

SEQ ID NO: 3212 - skipped

SEQ ID NO: 3213 - protein, 16 aa, Canis lupus familiaris
ITNSGTLSTTQKRELL

SEQ ID NO: 3214 - protein, 17 aa, Canis lupus familiaris
IWQDSRNIWQIGGFRSN

SEQ ID NO: 3215 - protein, 19 aa, Canis lupus familiaris
KAACFKRLLAETCWDGNAL

SEQ ID NO: 3216 - skipped

SEQ ID NO: 3217 - protein, 12 aa, Canis lupus familiaris
KAAICTTPALVK

SEQ ID NO: 3218 - protein, 10 aa, Canis lupus familiaris
KAALFKTKIS

SEQ ID NO: 3219 - protein, 15 aa, Canis lupus familiaris
KACRAEDGPGFAAHP

SEQ ID NO: 3220 - protein, 41 aa, Canis lupus familiaris
KAEEWKFCKAQLPILLLCCWQQGPFSLCLAHVSETAFGCHP

SEQ ID NO: 3221 - protein, 9 aa, Canis lupus familiaris
KAEITRRKC

SEQ ID NO: 3222 - protein, 26 aa, Canis lupus familiaris
KAEKKVTQKTEEKQKRSHRYNSRFLK

SEQ ID NO: 3223 - protein, 67 aa, Canis lupus familiaris
KAERNWEQCRSLRSRSEENERWHGQSCSLPHKPNWLVVRELSGAQWRCARTSSSSRCAVRSGPVAAG

SEQ ID NO: 3224 - protein, 19 aa, Canis lupus familiaris
KAGAKRTRGFEASSSRSPP

SEQ ID NO: 3225 - protein, 23 aa, Canis lupus familiaris
KAKAQSGLPAGIHSTHKSDIHSR

SEQ ID NO: 3226 - protein, 42 aa, Canis lupus familiaris
KAKPPITSSLWTPQTCLGMGTTLWAKSDLMSWALSSPSLTMG

SEQ ID NO: 3227 - protein, 24 aa, Canis lupus familiaris
KAKRLSTQLFPIHSDHQQRDYERN

SEQ ID NO: 3228 - protein, 54 aa, Canis lupus familiaris
KALFYIRGSILERISMNVKTVVRSLVLTETSLTTRDYTMGKSHMNVESVGKLSS

SEQ ID NO: 3229 - protein, 70 aa, Canis lupus familiaris
KALWSWLMPWQPAASPPGCPHSIGNGLLNSLCALLLRMTATIKLLPKHSPIWEEISENAPLSSWRLIRTG

SEQ ID NO: 3230 - protein, 8 aa, Canis lupus familiaris
KAMGFGRF

SEQ ID NO: 3231 - protein, 10 aa, Canis lupus familiaris
KANSNCEHHL

SEQ ID NO: 3232 - skipped

SEQ ID NO: 3233 - protein, 15 aa, Canis lupus familiaris
KAQGTDEFYELRGRT

SEQ ID NO: 3234 - protein, 10 aa, Canis lupus familiaris
KAQTGQPSGD

SEQ ID NO: 3235 - protein, 10 aa, Canis lupus familiaris
KARHQGNRKQ

SEQ ID NO: 3236 - protein, 85 aa, Canis lupus familiaris
KAVCEAGGVSFEEAYGKMCLEGSQYPIPRSPVRSCESWGCFGVRPRWRSGGPPKEESHELGLGKEFCPHEKEEEGELGPCFIRPC

SEQ ID NO: 3237 - protein, 8 aa, Canis lupus familiaris
KAVVAALG

SEQ ID NO: 3238 - protein, 12 aa, Canis lupus familiaris
KCCGSNAVTAWL

SEQ ID NO: 3239 - protein, 9 aa, Canis lupus familiaris
KCCLQSRSC

SEQ ID NO: 3240 - protein, 9 aa, Canis lupus familiaris
KCGNHFSSN

SEQ ID NO: 3241 - protein, 10 aa, Canis lupus familiaris
KCGTKTNCKR

SEQ ID NO: 3242 - protein, 21 aa, Canis lupus familiaris
KCGWGLRHRRYEKQNCLEEEA

SEQ ID NO: 3243 - protein, 18 aa, Canis lupus familiaris
KCHCYRELYFSSREDSEV

SEQ ID NO: 3244 - protein, 9 aa, Canis lupus familiaris
KCIIYRCGI

SEQ ID NO: 3245 - protein, 8 aa, Canis lupus familiaris
KCINVPRW

SEQ ID NO: 3246 - protein, 14 aa, Canis lupus familiaris
KCNYGVIRNEKTAS

SEQ ID NO: 3247 - protein, 8 aa, Canis lupus familiaris
KCQKGSAA

SEQ ID NO: 3248 - protein, 22 aa, Canis lupus familiaris
KCQWFGIQLRADEERELQSSQE

SEQ ID NO: 3249 - protein, 16 aa, Canis lupus familiaris
KCRKRKAAEKSEKEKG

SEQ ID NO: 3250 - protein, 17 aa, Canis lupus familiaris
KCRSYWTSWRTKEQSRL

SEQ ID NO: 3251 - protein, 23 aa, Canis lupus familiaris
KCSCRTQTCKIRERRGRTLSESA

SEQ ID NO: 3252 - protein, 35 aa, Canis lupus familiaris
KCSRNHPGLHQIKTPFKAGCSQKTETHSTTTTEPP

SEQ ID NO: 3253 - protein, 11 aa, Canis lupus familiaris
KCVSKAVSCGA

SEQ ID NO: 3254 - protein, 32 aa, Canis lupus familiaris
KCWRKLEQKIKSPNLALVFLQCQTSLLVPRYA

SEQ ID NO: 3255 - protein, 17 aa, Canis lupus familiaris
KCYFNSTSSSAEEKNQL

SEQ ID NO: 3256 - protein, 31 aa, Canis lupus familiaris
KDEQDHGHPKGTTGHLLDHPILVPVQVQKRN

SEQ ID NO: 3257 - skipped

SEQ ID NO: 3258 - protein, 17 aa, Canis lupus familiaris
KDLLLRSYYSILLSHNL

SEQ ID NO: 3259 - protein, 13 aa, Canis lupus familiaris
KDLYAKWKQVFMQ

SEQ ID NO: 3260 - protein, 29 aa, Canis lupus familiaris
KDPEDSASPHLLLLAQSPLVNSVSAAQPT

SEQ ID NO: 3261 - protein, 28 aa, Canis lupus familiaris
KDPEDSASPHLLLLAQSPLVNSVSAQPT

SEQ ID NO: 3262 - protein, 38 aa, Canis lupus familiaris
KDPEDSASPHLLLLAQSPLVNSVSEEKQWGTKWILCGN

SEQ ID NO: 3263 - protein, 18 aa, Canis lupus familiaris
KDRQQECGCIKTWCFRKK

SEQ ID NO: 3264 - protein, 44 aa, Canis lupus familiaris
KDRVGETWHGIWKLQKWYFTFRDFRYADHRTGNTHRSKAQKEVQ

SEQ ID NO: 3265 - protein, 20 aa, Canis lupus familiaris
KDSGEGSTTKDTRLQFWKVH

SEQ ID NO: 3266 - protein, 68 aa, Canis lupus familiaris
KDSQNREDAQAVQSSQVPQTPQAPEAPQTAEAQGWRQEKREEVQGGGLAHHPQPGPAGGTHQGGTDQN

SEQ ID NO: 3267 - protein, 14 aa, Canis lupus familiaris
KDWCEEEGREPSGT

SEQ ID NO: 3268 - skipped

SEQ ID NO: 3269 - protein, 9 aa, Canis lupus familiaris
KEASSEVYP

SEQ ID NO: 3270 - protein, 16 aa, Canis lupus familiaris
KEAYSTATAAGISQLL

SEQ ID NO: 3271 - protein, 34 aa, Canis lupus familiaris
KEDPHVTYIPTTQDLASTKAAEISSKERPQEKQA

SEQ ID NO: 3272 - protein, 16 aa, Canis lupus familiaris
KEEEKEEALQEIRGLC

SEQ ID NO: 3273 - protein, 9 aa, Canis lupus familiaris
KEEERPRVL

SEQ ID NO: 3274 - protein, 12 aa, Canis lupus familiaris
KEEFVKTLLKKK

SEQ ID NO: 3275 - protein, 27 aa, Canis lupus familiaris
KEENSLKNRNKKLKMLLNCLTQTKMKQ

SEQ ID NO: 3276 - protein, 90 aa, Canis lupus familiaris
KEERQRLREEERPVSSEIQGLLHPWRMQICEGAPGSILHLPPRLPWREVPWAEPSSRKSLIYLRPYNHLGCGGCGAVICLSACHRGASHV

SEQ ID NO: 3277 - protein, 15 aa, Canis lupus familiaris
KEESQQINAGNKSHT

SEQ ID NO: 3278 - protein, 19 aa, Canis lupus familiaris
KEETKAKEISSSPGWGTLG

SEQ ID NO: 3279 - protein, 19 aa, Canis lupus familiaris
KEGLQDCRECHQWGNIRRE

SEQ ID NO: 3280 - protein, 53 aa, Canis lupus familiaris
KEGVFQGTRKSSDPWEGVSSRRRQKPIQRIIRRWDEDGGAPEWLIRPPPKPPG

SEQ ID NO: 3281 - protein, 30 aa, Canis lupus familiaris
KEHLNYSRRGRKKSWKGSSNARRNLKEKSS

SEQ ID NO: 3282 - protein, 11 aa, Canis lupus familiaris
KEICPRRNHGD

SEQ ID NO: 3283 - protein, 16 aa, Canis lupus familiaris
KEIEMKGMWDMPSKYS

SEQ ID NO: 3284 - protein, 8 aa, Canis lupus familiaris
KEIERCFK

SEQ ID NO: 3285 - protein, 16 aa, Canis lupus familiaris
KEIEVLKCLLSWKPKD

SEQ ID NO: 3286 - protein, 16 aa, Canis lupus familiaris
KEIKTIPTTRQYSFRI

SEQ ID NO: 3287 - protein, 9 aa, Canis lupus familiaris
KEIQGGKET

SEQ ID NO: 3288 - protein, 51 aa, Canis lupus familiaris
KEIRCVQAVVILCSESSSVHEVLSSCVALFKGAREHTCLSETYRLISTTAI

SEQ ID NO: 3289 - protein, 32 aa, Canis lupus familiaris
KEIYHNSQWRSRNTASQFRIKKKEEEKEKNGG

SEQ ID NO: 3290 - protein, 14 aa, Canis lupus familiaris
KEKDDVSHNQKCRI

SEQ ID NO: 3291 - protein, 9 aa, Canis lupus familiaris
KEKEKENQT

SEQ ID NO: 3292 - protein, 9 aa, Canis lupus familiaris
KEKESFVGN

SEQ ID NO: 3293 - protein, 12 aa, Canis lupus familiaris
KEKKGTSFSLFL

SEQ ID NO: 3294 - protein, 10 aa, Canis lupus familiaris
KEKNFTPPGT

SEQ ID NO: 3295 - protein, 31 aa, Canis lupus familiaris
KEKQRKFIGILCQLPVSNNRNFESVKSALPI

SEQ ID NO: 3296 - protein, 28 aa, Canis lupus familiaris
KEKRGERQRERERRKAKKEEHVSLPGLL

SEQ ID NO: 3297 - protein, 27 aa, Canis lupus familiaris
KEKRKKRQAARVWMHQNLVLQKKMKDY

SEQ ID NO: 3298 - protein, 57 aa, Canis lupus familiaris
KEKRNIGKIPENTRKKRRSERKARKVHLVKVRLKILKHNPSLLSVQKRSLLYLKIDS

SEQ ID NO: 3299 - protein, 65 aa, Canis lupus familiaris
KELAAKFLQQSLQHKKGTQVSFFVLRHRGDCHTRLLRPVIPQTTARLHGDRLALHQVLQLLLCGH

SEQ ID NO: 3300 - protein, 16 aa, Canis lupus familiaris
KELMKVKVNSKQKTVK

SEQ ID NO: 3301 - protein, 19 aa, Canis lupus familiaris
KELQQIKKKSVHWVHGSLM

SEQ ID NO: 3302 - protein, 9 aa, Canis lupus familiaris
KENALHPGL

SEQ ID NO: 3303 - protein, 21 aa, Canis lupus familiaris
KENLKVITKRRYHRMKARNIQ

SEQ ID NO: 3304 - protein, 19 aa, Canis lupus familiaris
KENLWPCHPQKEVYQASKI

SEQ ID NO: 3305 - protein, 9 aa, Canis lupus familiaris
KEQKQRSSI

SEQ ID NO: 3306 - protein, 26 aa, Canis lupus familiaris
KERKKKIGAFPGYCSKGAQKSKDMDA

SEQ ID NO: 3307 - protein, 9 aa, Canis lupus familiaris
KERKKSSVD

SEQ ID NO: 3308 - protein, 19 aa, Canis lupus familiaris
KERLLQEVQKTREEQIPVY

SEQ ID NO: 3309 - protein, 26 aa, Canis lupus familiaris
KERLQKLQMLSLSHCHLQNQNLLKLR

SEQ ID NO: 3310 - protein, 12 aa, Canis lupus familiaris
KERREKKFFFRK

SEQ ID NO: 3311 - protein, 42 aa, Canis lupus familiaris
KERTKPKKMKSHHIKNPDYLLQKRPLRKRIKGIHPQRNQKVV

SEQ ID NO: 3312 - protein, 11 aa, Canis lupus familiaris
KERTKRQKTKF

SEQ ID NO: 3313 - protein, 12 aa, Canis lupus familiaris
KERVQSSPCLIF

SEQ ID NO: 3314 - protein, 17 aa, Canis lupus familiaris
KESIMIHLSMRLMFKCS

SEQ ID NO: 3315 - protein, 11 aa, Canis lupus familiaris
KESLHIHCVDR

SEQ ID NO: 3316 - skipped

SEQ ID NO: 3317 - protein, 39 aa, Canis lupus familiaris
KFCFIGAFGTTAEWTYWSMWSCRRSHWNIWRAFSIGTRS

SEQ ID NO: 3318 - protein, 37 aa, Canis lupus familiaris
KFCFIGAFGTTAEWTYWSMWSCRRSHWNIWREHHSLR

SEQ ID NO: 3319 - protein, 8 aa, Canis lupus familiaris
KFDPQKTD

SEQ ID NO: 3320 - protein, 19 aa, Canis lupus familiaris
KFFICSLLLHSKRNLISST

SEQ ID NO: 3321 - protein, 39 aa, Canis lupus familiaris
KFFPRWASVMCLLQEQTSQASQRRISQLSLRRCMKPQWR

SEQ ID NO: 3322 - protein, 33 aa, Canis lupus familiaris
KFKTKTKSWTLCCCNWHSIVFLEWKRWLQKSTE

SEQ ID NO: 3323 - skipped

SEQ ID NO: 3324 - protein, 63 aa, Canis lupus familiaris
KFMKNSQNMPCFENTLLLLHQIMKFLLRQLNPRIWKLKLIQPNPWLTLWTGRIPRLSHISTLS

SEQ ID NO: 3325 - protein, 9 aa, Canis lupus familiaris
KFPKGHLFT

SEQ ID NO: 3326 - protein, 8 aa, Canis lupus familiaris
KFPVQGCN

SEQ ID NO: 3327 - protein, 13 aa, Canis lupus familiaris
KFQLKSPGRDRKL

SEQ ID NO: 3328 - protein, 17 aa, Canis lupus familiaris
KFSGYHENKRVFPEVWI

SEQ ID NO: 3329 - protein, 24 aa, Canis lupus familiaris
KFSMATGQPLYLIHLSLAALSPCP

SEQ ID NO: 3330 - protein, 10 aa, Canis lupus familiaris
KFTSKFTQYI

SEQ ID NO: 3331 - protein, 19 aa, Canis lupus familiaris
KFWEKNQMSLLTNWGKRLS

SEQ ID NO: 3332 - protein, 19 aa, Canis lupus familiaris
KFWYKAWSCLRWRNMPSSF

SEQ ID NO: 3333 - protein, 11 aa, Canis lupus familiaris
KFYKASMVMEH

SEQ ID NO: 3334 - protein, 15 aa, Canis lupus familiaris
KGCTKRNQKGSRLKF

SEQ ID NO: 3335 - protein, 21 aa, Canis lupus familiaris
KGCVCRSKEEMGETDCASPQP

SEQ ID NO: 3336 - protein, 21 aa, Canis lupus familiaris
KGDQNHPNYETIQFSYMMQIN

SEQ ID NO: 3337 - protein, 16 aa, Canis lupus familiaris
KGEHFHWNRGSAACHR

SEQ ID NO: 3338 - protein, 20 aa, Canis lupus familiaris
KGEKMLKNQKGISLEQRSKT

SEQ ID NO: 3339 - skipped

SEQ ID NO: 3340 - protein, 9 aa, Canis lupus familiaris
KGGIPEGPS

SEQ ID NO: 3341 - protein, 8 aa, Canis lupus familiaris
KGGQEGEL

SEQ ID NO: 3342 - protein, 11 aa, Canis lupus familiaris
KGICKHCHNNL

SEQ ID NO: 3343 - protein, 17 aa, Canis lupus familiaris
KGICPFRQNQRNSSTFF

SEQ ID NO: 3344 - protein, 25 aa, Canis lupus familiaris
KGILTKWTRPSRFCIWRSCRQEQVG

SEQ ID NO: 3345 - protein, 23 aa, Canis lupus familiaris
KGKEEKLGGLKWWQEAHAGLQKG

SEQ ID NO: 3346 - protein, 25 aa, Canis lupus familiaris
KGKKEACGPRRKFSIYSTRHRPILR

SEQ ID NO: 3347 - protein, 8 aa, Canis lupus familiaris
KGKREGKD

SEQ ID NO: 3348 - protein, 9 aa, Canis lupus familiaris
KGKRQCPTL

SEQ ID NO: 3349 - protein, 24 aa, Canis lupus familiaris
KGKSSAEKGSRFSYCWPDQNPQIF

SEQ ID NO: 3350 - protein, 25 aa, Canis lupus familiaris
KGKYLSRNRNLYRRSQKKKYVLIQN

SEQ ID NO: 3351 - protein, 9 aa, Canis lupus familiaris
KGLAGRLKK

SEQ ID NO: 3352 - protein, 13 aa, Canis lupus familiaris
KGLHQKEPKRIQA

SEQ ID NO: 3353 - protein, 10 aa, Canis lupus familiaris
KGLLDARIPV

SEQ ID NO: 3354 - protein, 24 aa, Canis lupus familiaris
KGLPRATSHQNCAKSQWHPREVKI

SEQ ID NO: 3355 - protein, 53 aa, Canis lupus familiaris
KGNGLWKILKLVAHWVKESLVMFTWQGKNKASLSWLLKYYLKLNWRKQELNIS

SEQ ID NO: 3356 - protein, 18 aa, Canis lupus familiaris
KGNRYSSGDPNSYSYTAS

SEQ ID NO: 3357 - protein, 9 aa, Canis lupus familiaris
KGQERKGYG

SEQ ID NO: 3358 - protein, 35 aa, Canis lupus familiaris
KGRAGKQLGENRAPARAKAEGQNSGDGGATQSSVY

SEQ ID NO: 3359 - protein, 8 aa, Canis lupus familiaris
KGRFLAAE

SEQ ID NO: 3360 - protein, 44 aa, Canis lupus familiaris
KGRGASVGDICGTVLCFADVAATICKRQHCLDGTVLPTHGSVPI

SEQ ID NO: 3361 - protein, 30 aa, Canis lupus familiaris
KGRMESRSRGHVSGDSQVYHCFYFCSGPSC

SEQ ID NO: 3362 - protein, 34 aa, Canis lupus familiaris
KGRSMSLSPPLFRTTSSPVMKRQLRSLARKHVRE

SEQ ID NO: 3363 - protein, 14 aa, Canis lupus familiaris
KGSQEKSCIRIPVS

SEQ ID NO: 3364 - protein, 14 aa, Canis lupus familiaris
KGSREENRRDKVAS

SEQ ID NO: 3365 - protein, 12 aa, Canis lupus familiaris
KGYSRKQATECL

SEQ ID NO: 3366 - protein, 23 aa, Canis lupus familiaris
KHCRISETPQKPLNQQKAQLLQK

SEQ ID NO: 3367 - protein, 66 aa, Canis lupus familiaris
KHFALNYNVGVLRVSQNHSNISSKRKLKMNQKDCWILKMSSVTFRQTQSHQKYGTGWRPPSRGKWG

SEQ ID NO: 3368 - protein, 14 aa, Canis lupus familiaris
KHLKASNKSHTGTP

SEQ ID NO: 3369 - protein, 14 aa, Canis lupus familiaris
KHLPGSDLENLHEK

SEQ ID NO: 3370 - protein, 19 aa, Canis lupus familiaris
KHNKKLYHRRKEGSGRSYL

SEQ ID NO: 3371 - protein, 10 aa, Canis lupus familiaris
KHQAGLCSVQ

SEQ ID NO: 3372 - skipped

SEQ ID NO: 3373 - protein, 27 aa, Canis lupus familiaris
KHQRCAASQQSASFSATSAHSAYPILR

SEQ ID NO: 3374 - protein, 45 aa, Canis lupus familiaris
KHSLDPKGYGVSPELWTPASGLHEFQHPRVPRLWHCHPGPQHICG

SEQ ID NO: 3375 - protein, 16 aa, Canis lupus familiaris
KHTPTLCCCLRDENLC

SEQ ID NO: 3376 - protein, 12 aa, Canis lupus familiaris
KHWMVLKTLLFS

SEQ ID NO: 3377 - protein, 11 aa, Canis lupus familiaris
KIAMTMSQCPF

SEQ ID NO: 3378 - protein, 22 aa, Canis lupus familiaris
KIANHLQRLLLEEAKLNFVRGD

SEQ ID NO: 3379 - protein, 19 aa, Canis lupus familiaris
KIERKILHCCGRCLAVPQA

SEQ ID NO: 3380 - protein, 10 aa, Canis lupus familiaris
KIESWTKLHP

SEQ ID NO: 3381 - protein, 14 aa, Canis lupus familiaris
KIFLTIMSKCFSQF

SEQ ID NO: 3382 - protein, 24 aa, Canis lupus familiaris
KIFQETCHLIMKMTLFYFQLQKNA

SEQ ID NO: 3383 - protein, 11 aa, Canis lupus familiaris
KIFSPIMPQHF

SEQ ID NO: 3384 - protein, 10 aa, Canis lupus familiaris
KIFYLQFVIA

SEQ ID NO: 3385 - protein, 12 aa, Canis lupus familiaris
KIGEEFTSHCCF

SEQ ID NO: 3386 - protein, 8 aa, Canis lupus familiaris
KIGTITLS

SEQ ID NO: 3387 - protein, 13 aa, Canis lupus familiaris
KIIDTERMSSSRD

SEQ ID NO: 3388 - protein, 25 aa, Canis lupus familiaris
KIIKISQIQNQRMNKNFHFRLKRNC

SEQ ID NO: 3389 - protein, 34 aa, Canis lupus familiaris
KIITVKGSITTMKGTDQEACPVIDQKLHLQGLTG

SEQ ID NO: 3390 - protein, 26 aa, Canis lupus familiaris
KIKIIKNTKLLSVIFSVGSQCHIMLL

SEQ ID NO: 3391 - protein, 51 aa, Canis lupus familiaris
KIKKISQVLMWRVGMKMMIPPSKLRRWPKRRQKRKSVKEKREMKKKQNYGS

SEQ ID NO: 3392 - protein, 20 aa, Canis lupus familiaris
KIKLELLSLMMGLPWVWLTF

SEQ ID NO: 3393 - protein, 23 aa, Canis lupus familiaris
KIKPLRMFASLLQNPSNLKGSMK

SEQ ID NO: 3394 - protein, 16 aa, Canis lupus familiaris
KIKRRMRKKAPLLISV

SEQ ID NO: 3395 - protein, 14 aa, Canis lupus familiaris
KIKSGKKRGLTFLL

SEQ ID NO: 3396 - protein, 22 aa, Canis lupus familiaris
KILKKSFTSSLTEFLSPFRDLL

SEQ ID NO: 3397 - protein, 39 aa, Canis lupus familiaris
KILLSLLYRYCPMWILIAFQMVVLMLIYLCLVPKKNLLL

SEQ ID NO: 3398 - protein, 69 aa, Canis lupus familiaris
KILLYWSFWNDCRMDILVNVELQKKPLEYLERASFVAMKMKLTLRLYIALYVQLICAQSVLKLLILQRH

SEQ ID NO: 3399 - protein, 47 aa, Canis lupus familiaris
KILLYWSFWNDCRMDILVNVELQKKPLEYLESIQYWNQKLTRSEHQF

SEQ ID NO: 3400 - protein, 29 aa, Canis lupus familiaris
KILRVLGFISINMENQKKTSWDCRLSKKD

SEQ ID NO: 3401 - protein, 25 aa, Canis lupus familiaris
KILTMRQWLKSRSLERTPLLIIQST

SEQ ID NO: 3402 - protein, 10 aa, Canis lupus familiaris
KILWMTFLRV

SEQ ID NO: 3403 - protein, 21 aa, Canis lupus familiaris
KIMVLRLPYLKHYLTCQFLWF

SEQ ID NO: 3404 - skipped

SEQ ID NO: 3405 - protein, 14 aa, Canis lupus familiaris
KIPSLNAQWMFLRI

SEQ ID NO: 3406 - skipped

SEQ ID NO: 3407 - protein, 32 aa, Canis lupus familiaris
KIQDQDQELDTVLLQLALDCIFGVEEMATKKH

SEQ ID NO: 3408 - protein, 21 aa, Canis lupus familiaris
KIRPPKNRLRRQNVKHPCLRP

SEQ ID NO: 3409 - protein, 10 aa, Canis lupus familiaris
KIRTEILLRT

SEQ ID NO: 3410 - protein, 85 aa, Canis lupus familiaris
KISIYWSRRKLWELVMDAQKTLLYLAEHISMDRVSLLQFRKCLSSMALKEVLISERYSQMGCYSIMLQGLTCSPFLWITARWSWT

SEQ ID NO: 3411 - protein, 8 aa, Canis lupus familiaris
KISKMIFV

SEQ ID NO: 3412 - protein, 52 aa, Canis lupus familiaris
KISNNVSCSILQMVVLLSCTPFGRMRSGQPQSLRRLTRFGIGGTTTGCWLAS

SEQ ID NO: 3413 - skipped

SEQ ID NO: 3414 - protein, 10 aa, Canis lupus familiaris
KISTQISWKR

SEQ ID NO: 3415 - skipped

SEQ ID NO: 3416 - protein, 21 aa, Canis lupus familiaris
KITLQVRGTAAALKRDFTINM

SEQ ID NO: 3417 - protein, 18 aa, Canis lupus familiaris
KITVVENYIGIISCQMEL

SEQ ID NO: 3418 - protein, 9 aa, Canis lupus familiaris
KIVAMQQCI

SEQ ID NO: 3419 - protein, 21 aa, Canis lupus familiaris
KIWIKSLNGKNTMAAELSHLL

SEQ ID NO: 3420 - protein, 25 aa, Canis lupus familiaris
KIWNGNLLSSRDLAKGTMIDPITIK

SEQ ID NO: 3421 - protein, 13 aa, Canis lupus familiaris
KIYLKIYSIYLIR

SEQ ID NO: 3422 - protein, 11 aa, Canis lupus familiaris
KKDCRNFKCYH

SEQ ID NO: 3423 - protein, 17 aa, Canis lupus familiaris
KKDVRKKKRPFRKVHCM

SEQ ID NO: 3424 - protein, 9 aa, Canis lupus familiaris
KKEYNHHHA

SEQ ID NO: 3425 - protein, 10 aa, Canis lupus familiaris
KKGKKSMRVN

SEQ ID NO: 3426 - protein, 8 aa, Canis lupus familiaris
KKGQNQKR

SEQ ID NO: 3427 - protein, 30 aa, Canis lupus familiaris
KKHKYFWICFLTELGMGHFSAPLRKDPLSW

SEQ ID NO: 3428 - protein, 61 aa, Canis lupus familiaris
KKKKRKMKKKKMKRRTLKRTPRKRTRRKVQQKKRKRENRPRPGDERPPTVRAAERAGSPGP

SEQ ID NO: 3429 - protein, 8 aa, Canis lupus familiaris
KKKMKWMS

SEQ ID NO: 3430 - skipped

SEQ ID NO: 3431 - protein, 20 aa, Canis lupus familiaris
KKLCLLVKNRWMLSKSLLSH

SEQ ID NO: 3432 - protein, 38 aa, Canis lupus familiaris
KKLNNQPYPCPIYMRPLCLYFLTISEKLGLTRRDFGKP

SEQ ID NO: 3433 - protein, 15 aa, Canis lupus familiaris
KKMNCLEIADLLQRK

SEQ ID NO: 3434 - protein, 46 aa, Canis lupus familiaris
KKNQASLKIHLLLKEWRLMKLLTLMTWMNTLSYYMKIFLTKFGVLL

SEQ ID NO: 3435 - protein, 18 aa, Canis lupus familiaris
KKPNKNTQITFSLTSFTL

SEQ ID NO: 3436 - protein, 11 aa, Canis lupus familiaris
KKRDKELLHLQ

SEQ ID NO: 3437 - protein, 9 aa, Canis lupus familiaris
KKRIILQKM

SEQ ID NO: 3438 - protein, 9 aa, Canis lupus familiaris
KKRKISEKS

SEQ ID NO: 3439 - protein, 20 aa, Canis lupus familiaris
KKSSGLACLPILLRNVKILR

SEQ ID NO: 3440 - protein, 45 aa, Canis lupus familiaris
KKTKNLPLKSKLKKRENKTILILQIAEHHLLHPRIMNRVQLYEIC

SEQ ID NO: 3441 - protein, 25 aa, Canis lupus familiaris
KKTLCHYVQKIQIYHPPRYRSCQIG

SEQ ID NO: 3442 - skipped

SEQ ID NO: 3443 - protein, 59 aa, Canis lupus familiaris
KLAQRPLSELHSLLLRHLHGLGLAAGHGPPRQPGLQPGHPAGGPAGCSGQPGLRGLGGL

SEQ ID NO: 3444 - protein, 51 aa, Canis lupus familiaris
KLCCATEEKGPAPPIREDCHPVPGVQLDSPPGGACHGLCACGGCLHLEAGL

SEQ ID NO: 3445 - protein, 11 aa, Canis lupus familiaris
KLDVAILENYD

SEQ ID NO: 3446 - protein, 10 aa, Canis lupus familiaris
KLEESSLDRD

SEQ ID NO: 3447 - protein, 14 aa, Canis lupus familiaris
KLEETTLPERRYQK

SEQ ID NO: 3448 - protein, 32 aa, Canis lupus familiaris
KLEKSLQVIAASSLPHKEWIRACCYKCQRTHL

SEQ ID NO: 3449 - protein, 21 aa, Canis lupus familiaris
KLEPLLFPESFGAQDYHHCPE

SEQ ID NO: 3450 - protein, 11 aa, Canis lupus familiaris
KLEVCCYHLNN

SEQ ID NO: 3451 - protein, 19 aa, Canis lupus familiaris
KLGQERSMEVFFGESSGCG

SEQ ID NO: 3452 - protein, 16 aa, Canis lupus familiaris
KLHEKEIEKTVFVQSI

SEQ ID NO: 3453 - protein, 19 aa, Canis lupus familiaris
KLHKLQGFGYHNSKMVSRY

SEQ ID NO: 3454 - protein, 12 aa, Canis lupus familiaris
KLHPRSSNPQLE

SEQ ID NO: 3455 - skipped

SEQ ID NO: 3456 - protein, 37 aa, Canis lupus familiaris
KLIRFLKTKKSKLLVAKMFLSFSSEHWGKYYIVKEHL

SEQ ID NO: 3457 - protein, 8 aa, Canis lupus familiaris
KLKNLRIK

SEQ ID NO: 3458 - protein, 13 aa, Canis lupus familiaris
KLKQQDVPQVLLD

SEQ ID NO: 3459 - protein, 16 aa, Canis lupus familiaris
KLKTYRSVLAQTRTFF

SEQ ID NO: 3460 - protein, 9 aa, Canis lupus familiaris
KLLEHPLLP

SEQ ID NO: 3461 - protein, 9 aa, Canis lupus familiaris
KLLLCNSAL

SEQ ID NO: 3462 - protein, 39 aa, Canis lupus familiaris
KLLVQANFQQHFPPNIQKMTQTTVCGSHLKAKVEMAGPI

SEQ ID NO: 3463 - protein, 40 aa, Canis lupus familiaris
KLLVQANFQQHFPPNIQKMTQTTVCGSHLKVGQVGTPWFF

SEQ ID NO: 3464 - protein, 36 aa, Canis lupus familiaris
KLLVQANFQQHFPPNIQKMTQTTVCGSHLKVVISAS

SEQ ID NO: 3465 - protein, 13 aa, Canis lupus familiaris
KLPLHVWLGPSIL

SEQ ID NO: 3466 - protein, 11 aa, Canis lupus familiaris
KLQHLTNIPER

SEQ ID NO: 3467 - protein, 16 aa, Canis lupus familiaris
KLQIQPISISLIKLAS

SEQ ID NO: 3468 - protein, 8 aa, Canis lupus familiaris
KLRKSCIG

SEQ ID NO: 3469 - protein, 25 aa, Canis lupus familiaris
KLRLKWILHGFFYCATIFICKGLII

SEQ ID NO: 3470 - protein, 11 aa, Canis lupus familiaris
KLRNGLNQPQE

SEQ ID NO: 3471 - protein, 14 aa, Canis lupus familiaris
KLRQKKLCLTVPVL

SEQ ID NO: 3472 - protein, 13 aa, Canis lupus familiaris
KLRRISIVPGFEI

SEQ ID NO: 3473 - protein, 21 aa, Canis lupus familiaris
KLRTSQSWKAGKSWKIMRRNR

SEQ ID NO: 3474 - protein, 21 aa, Canis lupus familiaris
KLRWHFRNSSHGQNYNQRLDL

SEQ ID NO: 3475 - protein, 10 aa, Canis lupus familiaris
KLSKNRKHNL

SEQ ID NO: 3476 - skipped

SEQ ID NO: 3477 - protein, 52 aa, Canis lupus familiaris
KLSLIIEKMYPSVQNLVILVAKSGIRHKVKTNFLFRQDWSAACLLVAPKMRP

SEQ ID NO: 3478 - protein, 20 aa, Canis lupus familiaris
KLSVICFVIFKRVRKELQKW

SEQ ID NO: 3479 - protein, 12 aa, Canis lupus familiaris
KLVCDALSSVTL

SEQ ID NO: 3480 - protein, 17 aa, Canis lupus familiaris
KLVPWCSGVRRERNNWG

SEQ ID NO: 3481 - protein, 30 aa, Canis lupus familiaris
KLVVLQKWLILKKDLLKLQSEKGNRHLKTT

SEQ ID NO: 3482 - protein, 10 aa, Canis lupus familiaris
KMANTTAGHL

SEQ ID NO: 3483 - protein, 48 aa, Canis lupus familiaris
KMCLRKYRSKVKMYPQHCHQRLELQQDPVHHHLGKDPSTNWILLILLN

SEQ ID NO: 3484 - protein, 12 aa, Canis lupus familiaris
KMDHHLLKIFKY

SEQ ID NO: 3485 - protein, 9 aa, Canis lupus familiaris
KMEDMIWEF

SEQ ID NO: 3486 - protein, 67 aa, Canis lupus familiaris
KMGPTPSPRPPQPRSGSSSVASCSGASPSCCGSGPSSASWPTASRCTTRRTRPRTTCTWAWSWLLWS

SEQ ID NO: 3487 - protein, 29 aa, Canis lupus familiaris
KMHQCSQMVEGKPFPLKRNLTLRNLHLLR

SEQ ID NO: 3488 - protein, 51 aa, Canis lupus familiaris
KMIHCSVVSRREDWNLHLCLTQYMQKIMSRKQIKPLQNCILSRKISLQHGL

SEQ ID NO: 3489 - protein, 33 aa, Canis lupus familiaris
KMILFQLTSCYCPALSLTASAMSKQLNWMEKPI

SEQ ID NO: 3490 - protein, 15 aa, Canis lupus familiaris
KMIRKILKRRKTANR

SEQ ID NO: 3491 - protein, 18 aa, Canis lupus familiaris
KMKDMLNVPLRSCGLILQ

SEQ ID NO: 3492 - protein, 27 aa, Canis lupus familiaris
KMKDMLNVPLSYPSCTLKKIWRSSFLA

SEQ ID NO: 3493 - protein, 9 aa, Canis lupus familiaris
KMKKESKIK

SEQ ID NO: 3494 - protein, 9 aa, Canis lupus familiaris
KMKKRIMVH

SEQ ID NO: 3495 - protein, 32 aa, Canis lupus familiaris
KMKLPSSRTKKKHSMLVSKQPLEKTINLLISS

SEQ ID NO: 3496 - protein, 42 aa, Canis lupus familiaris
KMKLTLAVLPTLRNLHCYPQLCLQGRLAARNANMNLEILLGV

SEQ ID NO: 3497 - protein, 47 aa, Canis lupus familiaris
KMKREKQKEMKKNVQCCVFNFMDTILLLIVYLKQMLRNLSPEAIGIH

SEQ ID NO: 3498 - protein, 11 aa, Canis lupus familiaris
KMKRKRRRVGC

SEQ ID NO: 3499 - protein, 48 aa, Canis lupus familiaris
KMKYVCPRSLCSSPSQGKVTDWEVPHQKLFLSQRVLKLRIKIICLLFN

SEQ ID NO: 3500 - protein, 91 aa, Canis lupus familiaris
KMLIASPPVTTGMCGYGTSGNPVQQWNISQLTSLKSMAWPGTQMLSTFLLLPVKTTLSSSGITASLGNTSAFSLARCLSGRPDTLLSATAW

SEQ ID NO: 3501 - protein, 45 aa, Canis lupus familiaris
KMLKSRQGISGSTSTWAVMWILTLLVLPSGVLWCWAMRAGWLATR

SEQ ID NO: 3502 - protein, 11 aa, Canis lupus familiaris
KMLLQLNQLQC

SEQ ID NO: 3503 - protein, 22 aa, Canis lupus familiaris
KMLLVQNGMKHSHLLFMCQNWR

SEQ ID NO: 3504 - protein, 12 aa, Canis lupus familiaris
KMLPTISELLKL

SEQ ID NO: 3505 - protein, 67 aa, Canis lupus familiaris
KMLRKQCCYSLVIKHPLVFKINLTRQGKTKDGVVQRLGFLNQQITLQKEFFICLLMFIKRWKPAATK

SEQ ID NO: 3506 - protein, 19 aa, Canis lupus familiaris
KMMPTLQILPWHLHSALLV

SEQ ID NO: 3507 - protein, 21 aa, Canis lupus familiaris
KMNPKRKTRKGMIWTRKKKAV

SEQ ID NO: 3508 - protein, 29 aa, Canis lupus familiaris
KMNSHLTIVNQNLQRPCWKKLMKREYQWH

SEQ ID NO: 3509 - protein, 17 aa, Canis lupus familiaris
KMPERLRSLKLGDTCFL

SEQ ID NO: 3510 - protein, 25 aa, Canis lupus familiaris
KMPFQLVKAQGFQILHHSQLHNDQS

SEQ ID NO: 3511 - protein, 12 aa, Canis lupus familiaris
KMPVVWDSASCR

SEQ ID NO: 3512 - protein, 48 aa, Canis lupus familiaris
KMQKKKSSREIRKRKRMMMMKKSEVQKKNLSLRNWPRLKLHWKKLLNF

SEQ ID NO: 3513 - protein, 12 aa, Canis lupus familiaris
KMQKVWGLETNN

SEQ ID NO: 3514 - protein, 29 aa, Canis lupus familiaris
KMRHKNELQKIMRQFRMVYNNVGRTDMII

SEQ ID NO: 3515 - protein, 10 aa, Canis lupus familiaris
KMRKKGQRGL

SEQ ID NO: 3516 - protein, 44 aa, Canis lupus familiaris
KMRRKKRNQLSARLQCFAIQIGLIGCICWWGQWLPSSMELHSLS

SEQ ID NO: 3517 - protein, 12 aa, Canis lupus familiaris
KMRRSVVVKRNF

SEQ ID NO: 3518 - protein, 29 aa, Canis lupus familiaris
KMRRYLDILRKLEVSGCIHLQQSSFLQST

SEQ ID NO: 3519 - protein, 32 aa, Canis lupus familiaris
KMSITPLFLFLTMHHLLNLPALFVVKWCQGMT

SEQ ID NO: 3520 - protein, 12 aa, Canis lupus familiaris
KMSLLQRTVFQQ

SEQ ID NO: 3521 - protein, 26 aa, Canis lupus familiaris
KMTIERKVEKRWIENMTKKNLKKTGI

SEQ ID NO: 3522 - protein, 11 aa, Canis lupus familiaris
KMTIPIEFLKL

SEQ ID NO: 3523 - protein, 9 aa, Canis lupus familiaris
KMTLRRIRG

SEQ ID NO: 3524 - protein, 9 aa, Canis lupus familiaris
KMTRCKRKS

SEQ ID NO: 3525 - protein, 10 aa, Canis lupus familiaris
KMTSRCKRKS

SEQ ID NO: 3526 - protein, 20 aa, Canis lupus familiaris
KMTWQICMSYFVLCPLVYLI

SEQ ID NO: 3527 - protein, 50 aa, Canis lupus familiaris
KMVFTSTIELCWNVTFLESHVVHRTSHMYSLNMEIVLLLIMVKIFKQRKK

SEQ ID NO: 3528 - protein, 35 aa, Canis lupus familiaris
KMVLDGMLTVIGQGLVGMMPPGLGPVAGVMAQMQR

SEQ ID NO: 3529 - protein, 45 aa, Canis lupus familiaris
KMVVATVSSMWKTQNISSPFFLSSFSSSSTKYALCRFLQDIMCRP

SEQ ID NO: 3530 - protein, 12 aa, Canis lupus familiaris
KMWRRNIGSGSQ

SEQ ID NO: 3531 - protein, 11 aa, Canis lupus familiaris
KMWVGTQTQKI

SEQ ID NO: 3532 - protein, 24 aa, Canis lupus familiaris
KMYLILKELLKTLNMIRALMWVVH

SEQ ID NO: 3533 - protein, 87 aa, Canis lupus familiaris
KNQSQLLPRALLEEELVAVENEVARKMILTGGPDSRRVTFHGMTRNSGCTFSGLLYFGVESCFTSCSRALGEKSRGRTLSITIFPKE

SEQ ID NO: 3534 - protein, 14 aa, Canis lupus familiaris
KNRIEMYKLLFDYV

SEQ ID NO: 3535 - protein, 12 aa, Canis lupus familiaris
KNRNREAAYEHN

SEQ ID NO: 3536 - protein, 13 aa, Canis lupus familiaris
KNSRLKQQKKWLS

SEQ ID NO: 3537 - protein, 22 aa, Canis lupus familiaris
KNYMKLTLGLNFWFSVDRFPVI

SEQ ID NO: 3538 - protein, 18 aa, Canis lupus familiaris
KPILGIQRRKQSKHLKNY

SEQ ID NO: 3539 - protein, 28 aa, Canis lupus familiaris
KPKWGPKLGPTRAVLVANQEMGRPPSGF

SEQ ID NO: 3540 - protein, 14 aa, Canis lupus familiaris
KPPENSTLQQHFYF

SEQ ID NO: 3541 - protein, 10 aa, Canis lupus familiaris
KPQHKALQQV

SEQ ID NO: 3542 - skipped

SEQ ID NO: 3543 - protein, 21 aa, Canis lupus familiaris
KPSGSFCRSFLCWKKGLHKYN

SEQ ID NO: 3544 - protein, 19 aa, Canis lupus familiaris
KPTHLPVILLSFWAVLPAM

SEQ ID NO: 3545 - protein, 18 aa, Canis lupus familiaris
KPVGPRILSSGHQGSRSC

SEQ ID NO: 3546 - protein, 15 aa, Canis lupus familiaris
KPYFTSEVPYWRESL

SEQ ID NO: 3547 - protein, 13 aa, Canis lupus familiaris
KQDLKEVVKFSIA

SEQ ID NO: 3548 - protein, 12 aa, Canis lupus familiaris
KQDRIFRVFQNH

SEQ ID NO: 3549 - protein, 9 aa, Canis lupus familiaris
KQECRHSDK

SEQ ID NO: 3550 - protein, 11 aa, Canis lupus familiaris
KQEQKGNWSAS

SEQ ID NO: 3551-3552 - skipped (2 entries)

SEQ ID NO: 3553 - protein, 85 aa, Canis lupus familiaris
KQHQEDLERKQTVLAQSPAVKLPSQETPRTVMLKIQILNWKKQSPIPQRGRRLQLLLKKMKKVKIIRKTVKILELQVPMMMYNYS

SEQ ID NO: 3554 - protein, 27 aa, Canis lupus familiaris
KQIPCGDLPGGDSVSNIPVYCQGQKPN

SEQ ID NO: 3555 - protein, 17 aa, Canis lupus familiaris
KQKRKVRKLVKRKERKR

SEQ ID NO: 3556 - protein, 28 aa, Canis lupus familiaris
KQNLQLPHLSGPHRPVSGWEQLCGQSQI

SEQ ID NO: 3557 - protein, 17 aa, Canis lupus familiaris
KQNQHPSPNFYCGQNKE

SEQ ID NO: 3558 - protein, 16 aa, Canis lupus familiaris
KQNSKKQLNGDSSMKQ

SEQ ID NO: 3559 - protein, 50 aa, Canis lupus familiaris
KQQQRAPLIKWKILARGSRFFRPGSHPQRHSQSQLSQARERGQPSTDFIP

SEQ ID NO: 3560 - protein, 11 aa, Canis lupus familiaris
KQRNLQVRDAF

SEQ ID NO: 3561 - protein, 40 aa, Canis lupus familiaris
KQSFTKTKDHPFWKKNLYVFMRERRKRPILKVTSLTLSRR

SEQ ID NO: 3562 - protein, 9 aa, Canis lupus familiaris
KQSFTSSLP

SEQ ID NO: 3563 - protein, 12 aa, Canis lupus familiaris
KQSSKSEKERQT

SEQ ID NO: 3564 - protein, 13 aa, Canis lupus familiaris
KQTEIVSGILAYC

SEQ ID NO: 3565 - protein, 26 aa, Canis lupus familiaris
KQVITLRKNFKRLSGFFCLKLKIRQS

SEQ ID NO: 3566 - protein, 18 aa, Canis lupus familiaris
KQWEDPTSPANVVALLQT

SEQ ID NO: 3567 - protein, 14 aa, Canis lupus familiaris
KQWSPCSWLHGNTL

SEQ ID NO: 3568 - protein, 14 aa, Canis lupus familiaris
KRAGCEVPSTKPSA

SEQ ID NO: 3569-3570 - skipped (2 entries)

SEQ ID NO: 3571 - protein, 16 aa, Canis lupus familiaris
KRASRCQDSCLRTVSR

SEQ ID NO: 3572 - protein, 41 aa, Canis lupus familiaris
KRCKKEMLVQFPRCFYGSEQSCDGHVISHLLCVLHSHYGAV

SEQ ID NO: 3573 - protein, 24 aa, Canis lupus familiaris
KRDYQNKKKRLQSYRFWQNVQIPY

SEQ ID NO: 3574 - protein, 36 aa, Canis lupus familiaris
KREDGKQVPRARLRRFPSISLLLLLLRPELLKSVLC

SEQ ID NO: 3575 - protein, 25 aa, Canis lupus familiaris
KREEREEILFPKMSTDSEIRTVKML

SEQ ID NO: 3576 - skipped

SEQ ID NO: 3577 - protein, 9 aa, Canis lupus familiaris
KREKAVPHT

SEQ ID NO: 3578 - protein, 51 aa, Canis lupus familiaris
KREKFHTTRNLRHWLGLVVSRMCTPKDGKGSVKLGPQKNGKGSVKLGLLVE

SEQ ID NO: 3579 - protein, 44 aa, Canis lupus familiaris
KREPLALPPSKRSLSSVENLIGLPIMPSRCENSSLGGMLEMLML

SEQ ID NO: 3580 - protein, 33 aa, Canis lupus familiaris
KREPREKLYQDTSLMMIVLTIQNVPFLSNIRMV

SEQ ID NO: 3581 - protein, 17 aa, Canis lupus familiaris
KRERKFCWKLNFKATVK

SEQ ID NO: 3582 - protein, 31 aa, Canis lupus familiaris
KRESRAMISLGALREDWNQKRSLGRQIPVVI

SEQ ID NO: 3583 - protein, 10 aa, Canis lupus familiaris
KRFKRGKQKG

SEQ ID NO: 3584-3585 - skipped (2 entries)

SEQ ID NO: 3586 - protein, 19 aa, Canis lupus familiaris
KRGMKRKRKVQLEKRMRRH

SEQ ID NO: 3587 - protein, 33 aa, Canis lupus familiaris
KRGPRRRALMALWLRAKQFLPKSQVSQRGQRTG

SEQ ID NO: 3588 - protein, 17 aa, Canis lupus familiaris
KRGRLQAVNMMCQHTML

SEQ ID NO: 3589 - protein, 32 aa, Canis lupus familiaris
KRGTFSLESWECSLSQVRLCLIVSKTLLPVRS

SEQ ID NO: 3590 - protein, 57 aa, Canis lupus familiaris
KRHLPFSSKPKKFQHLLLNVKISGGNAVNSSSETRSASTDMQQHNMLMRFATRLLLC

SEQ ID NO: 3591 - protein, 94 aa, Canis lupus familiaris
KRKAREALELLEAGLSRPSHAARRAPAAPLAQLPAAPSWPPPVPVRGDPSPRWAPGCRRDPHAVPRSSRSPAGADVGPRGGPEGAAPTRHPSFL

SEQ ID NO: 3592 - protein, 9 aa, Canis lupus familiaris
KRKCSSSRT

SEQ ID NO: 3593 - protein, 84 aa, Canis lupus familiaris
KRKDKKAKNKVLMIMIVKNGKIKIQNQKRLQSQKWKCTLGVMMMMMILINFLKKLKGKCRNQIKGGMGQKKMRITVKELKSVPE

SEQ ID NO: 3594 - protein, 23 aa, Canis lupus familiaris
KRKEKKDRQQECGCIKTWCFRKK

SEQ ID NO: 3595 - protein, 35 aa, Canis lupus familiaris
KRKEKKNWSLPRVLLQRCPKKQRHGCLKCMTIRQM

SEQ ID NO: 3596 - protein, 26 aa, Canis lupus familiaris
KRKENTVRKLNLPHFWNIHLKRKGES

SEQ ID NO: 3597 - protein, 33 aa, Canis lupus familiaris
KRKERNQFFIVFVIPVIVVLKIKKSMINTCLNT

SEQ ID NO: 3598 - protein, 13 aa, Canis lupus familiaris
KRKFLSQKKKLKK

SEQ ID NO: 3599 - skipped

SEQ ID NO: 3600 - protein, 13 aa, Canis lupus familiaris
KRKGTARLTTVTS

SEQ ID NO: 3601 - skipped

SEQ ID NO: 3602 - protein, 30 aa, Canis lupus familiaris
KRKINISRKNQNLKIKRLKKRKQALQILAS

SEQ ID NO: 3603 - protein, 27 aa, Canis lupus familiaris
KRKISCCRVKMHLSIIPRQRISNFQSP

SEQ ID NO: 3604 - protein, 12 aa, Canis lupus familiaris
KRKITARSTKNT

SEQ ID NO: 3605 - skipped

SEQ ID NO: 3606 - protein, 10 aa, Canis lupus familiaris
KRKKGSMWTT

SEQ ID NO: 3607 - protein, 33 aa, Canis lupus familiaris
KRKKRRKTEREREEKSQKRRTCQPTRSSVKSIG

SEQ ID NO: 3608 - protein, 54 aa, Canis lupus familiaris
KRKRCLSGRHLWHCIMFCRCCSNDMQKTALLGWNSFTDSWICTNLSPLKSRGFS

SEQ ID NO: 3609 - protein, 45 aa, Canis lupus familiaris
KRKRKRKPNLNALAVRRSVIPPRNLLHPRHLLSTGVGPHISLGSI

SEQ ID NO: 3610 - skipped

SEQ ID NO: 3611 - protein, 19 aa, Canis lupus familiaris
KRKRRSKVKITLLHRTQKN

SEQ ID NO: 3612 - protein, 20 aa, Canis lupus familiaris
KRKSKLRSLFVKGYPTTLEQ

SEQ ID NO: 3613 - protein, 11 aa, Canis lupus familiaris
KRKTRRQRLRL

SEQ ID NO: 3614 - protein, 8 aa, Canis lupus familiaris
KRKWWHFY

SEQ ID NO: 3615 - protein, 8 aa, Canis lupus familiaris
KRKWWYFY

SEQ ID NO: 3616 - protein, 12 aa, Canis lupus familiaris
KRLCVQIQRRNG

SEQ ID NO: 3617 - protein, 9 aa, Canis lupus familiaris
KRLLIFFLL

SEQ ID NO: 3618 - protein, 10 aa, Canis lupus familiaris
KRLLKELKNP

SEQ ID NO: 3619 - protein, 11 aa, Canis lupus familiaris
KRLPCKVTESS

SEQ ID NO: 3620 - protein, 13 aa, Canis lupus familiaris
KRLRKKRRKRRKK

SEQ ID NO: 3621 - protein, 72 aa, Canis lupus familiaris
KRLVRGRRQRAVGNVKNSSEHREAPSIWLNTHAMHQWNVTSVRGGRRIERFATSATLYRSYQFVHSVGKRSA

SEQ ID NO: 3622 - protein, 16 aa, Canis lupus familiaris
KRMIPRFWKKKNAVII

SEQ ID NO: 3623 - protein, 8 aa, Canis lupus familiaris
KRNGFCKI

SEQ ID NO: 3624-3625 - skipped (2 entries)

SEQ ID NO: 3626 - protein, 21 aa, Canis lupus familiaris
KRNGTVQEERKRRNSPRTSTD

SEQ ID NO: 3627 - skipped

SEQ ID NO: 3628 - protein, 14 aa, Canis lupus familiaris
KRNLAWETSSENQT

SEQ ID NO: 3629 - protein, 43 aa, Canis lupus familiaris
KRNLILMIKVHKFEHHLLPSPLHSLSKYTDKLKKARILLPPKA

SEQ ID NO: 3630 - skipped

SEQ ID NO: 3631 - protein, 12 aa, Canis lupus familiaris
KRNLTDLKVKRN

SEQ ID NO: 3632 - protein, 11 aa, Canis lupus familiaris
KRNMQTLPQQS

SEQ ID NO: 3633 - protein, 13 aa, Canis lupus familiaris
KRNSRRKRNLKPS

SEQ ID NO: 3634 - protein, 31 aa, Canis lupus familiaris
KRNSYKMDQTFKILYLEILQTRASGMNIKET

SEQ ID NO: 3635 - protein, 29 aa, Canis lupus familiaris
KRNVKRGNISQKKDQGEDQKEEKPLDAPK

SEQ ID NO: 3636 - protein, 27 aa, Canis lupus familiaris
KRNWLRSWLSSTCLATGASTVATTCIT

SEQ ID NO: 3637 - protein, 94 aa, Canis lupus familiaris
KRPATGHLSSELCQEPVAPKGSQNLSHRANAPSWVLLSRNSVSCFPSSMVICPNQVQSQCTPFRMALLNSTTCGKTSDILRWRKGKQGPVLRVK

SEQ ID NO: 3638 - skipped

SEQ ID NO: 3639 - protein, 11 aa, Canis lupus familiaris
KRPRKKGIWMN

SEQ ID NO: 3640 - protein, 15 aa, Canis lupus familiaris
KRPRRLRKNTLIKKN

SEQ ID NO: 3641 - protein, 20 aa, Canis lupus familiaris
KRPRRLSFSSPLASGSEPSR

SEQ ID NO: 3642 - protein, 29 aa, Canis lupus familiaris
KRPTCTRRRNLCYRANSPSWLCRSARRVW

SEQ ID NO: 3643 - protein, 22 aa, Canis lupus familiaris
KRQAARVWMHQNLVLQKKMKDY

SEQ ID NO: 3644 - protein, 13 aa, Canis lupus familiaris
KRRENYLKIMTQR

SEQ ID NO: 3645 - protein, 17 aa, Canis lupus familiaris
KRRFPLSHTVSSIDHPA

SEQ ID NO: 3646 - protein, 100 aa, Canis lupus familiaris
KRRKIEDAGQRAALLEEKGRRALRRRSTGQSLNPKNESIGLPLQRANVNLRTRSGSGLEVQHQPPRAAGPTVQRLLTLLPLPILLAVGLEVRQQKPIQLP

SEQ ID NO: 3647 - skipped

SEQ ID NO: 3648 - protein, 8 aa, Canis lupus familiaris
KRRLIWRS

SEQ ID NO: 3649 - skipped

SEQ ID NO: 3650 - protein, 23 aa, Canis lupus familiaris
KRRNSRRAILTFSGILQTKYLRV

SEQ ID NO: 3651 - protein, 22 aa, Canis lupus familiaris
KRRNSRRAILTFSGILTKYLRV

SEQ ID NO: 3652 - protein, 16 aa, Canis lupus familiaris
KRRPPRLQRMPPVGKH

SEQ ID NO: 3653 - protein, 63 aa, Canis lupus familiaris
KRRRKRRGTPGNPRTLLKTQNRTSPRPPAMRLLTVSGDWTAPSPSPTGCLWKVSGLSVRRENT

SEQ ID NO: 3654 - protein, 18 aa, Canis lupus familiaris
KRRRKTQSPMKWRVITES

SEQ ID NO: 3655 - protein, 44 aa, Canis lupus familiaris
KRRSARHLHSDDPRPCVYEGSRNILERAPPGETSLITMPSSSSP

SEQ ID NO: 3656 - protein, 12 aa, Canis lupus familiaris
KRRSLPRNSKVL

SEQ ID NO: 3657 - protein, 20 aa, Canis lupus familiaris
KRSIFHGHRSWDLPIIVNLS

SEQ ID NO: 3658 - protein, 10 aa, Canis lupus familiaris
KRSIGKESQD

SEQ ID NO: 3659 - protein, 10 aa, Canis lupus familiaris
KRSIGKEVLL

SEQ ID NO: 3660 - protein, 22 aa, Canis lupus familiaris
KRSIGKGIFYLVSATLPSRHCL

SEQ ID NO: 3661 - protein, 16 aa, Canis lupus familiaris
KRSIKRYRRSQPKEIV

SEQ ID NO: 3662 - protein, 27 aa, Canis lupus familiaris
KRSLGPQKSFPSPGWSRVSSKLSMSYS

SEQ ID NO: 3663 - protein, 31 aa, Canis lupus familiaris
KRSQNHLKRKVLGTILLYNHIIDYAWGICRL

SEQ ID NO: 3664 - protein, 24 aa, Canis lupus familiaris
KRSRGSLSEFYASFQFPTTETSSL

SEQ ID NO: 3665 - protein, 19 aa, Canis lupus familiaris
KRSRTLMMRKKQPNLLKNK

SEQ ID NO: 3666 - protein, 15 aa, Canis lupus familiaris
KRSVSPKKICIAPQF

SEQ ID NO: 3667 - protein, 32 aa, Canis lupus familiaris
KRTKRKIRKKKMRKKRGNRRKGRVGRGKQTQC

SEQ ID NO: 3668 - skipped

SEQ ID NO: 3669 - protein, 9 aa, Canis lupus familiaris
KRVNNAWKT

SEQ ID NO: 3670 - protein, 9 aa, Canis lupus familiaris
KRVQQKASN

SEQ ID NO: 3671 - protein, 41 aa, Canis lupus familiaris
KRVRNRSMKKAMSQQTVHQALKMSGLRLSHRRLLAGKRPGK

SEQ ID NO: 3672 - protein, 21 aa, Canis lupus familiaris
KRVSPHPLCGQMTPLHLNLGF

SEQ ID NO: 3673 - protein, 18 aa, Canis lupus familiaris
KSALWVVTTLFSITPSRL

SEQ ID NO: 3674 - protein, 23 aa, Canis lupus familiaris
KSASRQEVCGIQTSLLARRTRRR

SEQ ID NO: 3675 - skipped

SEQ ID NO: 3676 - protein, 32 aa, Canis lupus familiaris
KSCRRCCWDARQTCGPASLWWPSAAPSPYRTR

SEQ ID NO: 3677 - protein, 16 aa, Canis lupus familiaris
KSESPKWITSRYSLDT

SEQ ID NO: 3678 - protein, 45 aa, Canis lupus familiaris
KSFLAHHFMSQIILSEFWMCCGSVLMSSQLCMLLRMGPWKLLQMW

SEQ ID NO: 3679 - protein, 22 aa, Canis lupus familiaris
KSFNNGKQSMSSIPSVFLMWNR

SEQ ID NO: 3680 - protein, 8 aa, Canis lupus familiaris
KSFRKLVI

SEQ ID NO: 3681 - protein, 15 aa, Canis lupus familiaris
KSHQESPAHYRRRCI

SEQ ID NO: 3682 - protein, 16 aa, Canis lupus familiaris
KSHTKNRRKAKKKPQI

SEQ ID NO: 3683 - protein, 9 aa, Canis lupus familiaris
KSIHRNFAS

SEQ ID NO: 3684 - skipped

SEQ ID NO: 3685 - protein, 13 aa, Canis lupus familiaris
KSIKTRWLKRTRI

SEQ ID NO: 3686 - protein, 56 aa, Canis lupus familiaris
KSIRKKREKFHTTRNLRHWLGLVVSRMCTPKDGKGSVKLGPQKNGKGSVKLGLLVE

SEQ ID NO: 3687 - protein, 12 aa, Canis lupus familiaris
KSIRTLIQQKHL

SEQ ID NO: 3688 - protein, 16 aa, Canis lupus familiaris
KSIWCLLISQLVSSTS

SEQ ID NO: 3689 - protein, 10 aa, Canis lupus familiaris
KSKIESPSTH

SEQ ID NO: 3690 - protein, 38 aa, Canis lupus familiaris
KSKKVINPTISYPFRSPTKRLREELRSCKMQYSSKMSD

SEQ ID NO: 3691 - protein, 11 aa, Canis lupus familiaris
KSLFKETQNNR

SEQ ID NO: 3692 - protein, 38 aa, Canis lupus familiaris
KSLILSFQRVKQNKMKVDWQNLNQMKTDWWRQNQVKVS

SEQ ID NO: 3693 - protein, 47 aa, Canis lupus familiaris
KSLQKKNRKEEEKDLGRVLWSGKTERMNQSKRNPMDQIISSRGYLIF

SEQ ID NO: 3694 - protein, 41 aa, Canis lupus familiaris
KSLRKILGALSSPPATGKNKESLKNTSETNTSQPKLTSGRF

SEQ ID NO: 3695 - protein, 8 aa, Canis lupus familiaris
KSLTHGAW

SEQ ID NO: 3696 - skipped

SEQ ID NO: 3697 - protein, 8 aa, Canis lupus familiaris
KSMIECRI

SEQ ID NO: 3698 - protein, 9 aa, Canis lupus familiaris
KSNLERSED

SEQ ID NO: 3699 - protein, 13 aa, Canis lupus familiaris
KSNPGQSCTPNFL

SEQ ID NO: 3700 - protein, 19 aa, Canis lupus familiaris
KSNTVIYTSMWVRLSQREK

SEQ ID NO: 3701 - protein, 12 aa, Canis lupus familiaris
KSPLCVKNVGKF

SEQ ID NO: 3702 - protein, 14 aa, Canis lupus familiaris
KSPNWPTQWRLRRS

SEQ ID NO: 3703 - protein, 24 aa, Canis lupus familiaris
KSPTLCGSESTQSWGPMYKVYLNM

SEQ ID NO: 3704 - protein, 13 aa, Canis lupus familiaris
KSQGKLLKPNKGL

SEQ ID NO: 3705 - protein, 58 aa, Canis lupus familiaris
KSQLPHILPIRDRSFQRFFSGNKFPLEGEGFPTHTKTHTPTPRSRVARSSSDCARPAP

SEQ ID NO: 3706 - protein, 15 aa, Canis lupus familiaris
KSQTVPSTCEQRWSS

SEQ ID NO: 3707 - protein, 19 aa, Canis lupus familiaris
KSREELGAMQEPQVPLRGK

SEQ ID NO: 3708 - protein, 29 aa, Canis lupus familiaris
KSRGRSFIVVAGVWQCHRPSPILSSFSMG

SEQ ID NO: 3709 - skipped

SEQ ID NO: 3710 - protein, 8 aa, Canis lupus familiaris
KSRQSLPP

SEQ ID NO: 3711 - protein, 33 aa, Canis lupus familiaris
KSRRMEVLQSPAAHIAAVLLAARTVLSLSGSRV

SEQ ID NO: 3712 - protein, 40 aa, Canis lupus familiaris
KSRVGNESPAVCSGRGCECGGERSPRCGPHSPAEQHEGRV

SEQ ID NO: 3713 - protein, 8 aa, Canis lupus familiaris
KSSCCCSS

SEQ ID NO: 3714 - protein, 34 aa, Canis lupus familiaris
KSSGGGLGLIMLPWSGVEIIICLKRIVKRKKKKN

SEQ ID NO: 3715 - protein, 17 aa, Canis lupus familiaris
KSSHMHNTSPCQMMSHL

SEQ ID NO: 3716 - protein, 25 aa, Canis lupus familiaris
KSSIHIVEKQLKLQERSTNKKKRKN

SEQ ID NO: 3717 - protein, 16 aa, Canis lupus familiaris
KSSKLARNQIAVSHQQ

SEQ ID NO: 3718 - protein, 11 aa, Canis lupus familiaris
KSSKLTPPLKL

SEQ ID NO: 3719 - protein, 27 aa, Canis lupus familiaris
KSSRTRRRRKPSGKGRMMTRMIMMMGV

SEQ ID NO: 3720 - protein, 8 aa, Canis lupus familiaris
KSSTPWSG

SEQ ID NO: 3721 - skipped

SEQ ID NO: 3722 - protein, 25 aa, Canis lupus familiaris
KSSYIFWLKKIIRSNSMKLRNIMAQ

SEQ ID NO: 3723 - skipped

SEQ ID NO: 3724 - protein, 43 aa, Canis lupus familiaris
KSVNKRAGLVSSTKPLVQPGFILKRYRSFLNMEFLQTPKLTRK

SEQ ID NO: 3725 - protein, 95 aa, Canis lupus familiaris
KSVRILIPTSFKFWVHRHFNLDLGHQGKNLVNPLQSLGRKFQRLSVSLELRTKRMSLQSLPGLAAWPPVLHLRLLPPSSQKMGQRVSNPEFQVLF

SEQ ID NO: 3726 - protein, 8 aa, Canis lupus familiaris
KSVTQTTL

SEQ ID NO: 3727 - protein, 53 aa, Canis lupus familiaris
KSWGQWTSMMLLTCTVDQGIFWIAVGKFPVGYTGQKFRREICAIAIDWEITKC

SEQ ID NO: 3728 - protein, 14 aa, Canis lupus familiaris
KSWQMMKIIRIYRT

SEQ ID NO: 3729 - protein, 10 aa, Canis lupus familiaris
KSYPIKASLR

SEQ ID NO: 3730 - protein, 54 aa, Canis lupus familiaris
KTALKCIFVAVRAICVTKGFLIFRRWKSHSLLRTQLHLSHPITTYCFIPWCHLC

SEQ ID NO: 3731 - protein, 16 aa, Canis lupus familiaris
KTATACMAGPLHSVRR

SEQ ID NO: 3732 - protein, 40 aa, Canis lupus familiaris
KTCGTKDPFLWSSRISKLLTQGFTSVTQTRGKRWNCWCST

SEQ ID NO: 3733 - protein, 11 aa, Canis lupus familiaris
KTCPLVQWSPT

SEQ ID NO: 3734-3735 - skipped (2 entries)

SEQ ID NO: 3736 - protein, 12 aa, Canis lupus familiaris
KTHPYTMLLPQG

SEQ ID NO: 3737 - protein, 29 aa, Canis lupus familiaris
KTKEKEKLAQLRRNQNLKEVDLLPRRTAL

SEQ ID NO: 3738 - protein, 15 aa, Canis lupus familiaris
KTKPTSFPELLLWTK

SEQ ID NO: 3739 - protein, 47 aa, Canis lupus familiaris
KTLFGIVQTHVPKENSAQETWASLKLQNVPRSSTLRQEDKCNQWFHY

SEQ ID NO: 3740 - protein, 16 aa, Canis lupus familiaris
KTLKRCMKECMQLWEI

SEQ ID NO: 3741 - protein, 8 aa, Canis lupus familiaris
KTLMQRWP

SEQ ID NO: 3742 - protein, 46 aa, Canis lupus familiaris
KTLNWKREPRLSYLKTMYSSPFWSQIFPFLQCCHHHHLHHHYHHVL

SEQ ID NO: 3743 - protein, 14 aa, Canis lupus familiaris
KTLNWKRGPSVAPW

SEQ ID NO: 3744 - protein, 12 aa, Canis lupus familiaris
KTLNWKRNLLFG

SEQ ID NO: 3745 - protein, 22 aa, Canis lupus familiaris
KTLQKRNACTISKMLLWKRTKL

SEQ ID NO: 3746 - protein, 14 aa, Canis lupus familiaris
KTMNLSNIWMKFRL

SEQ ID NO: 3747 - protein, 33 aa, Canis lupus familiaris
KTMTGSLNQHTTEHLSSRIQSSSQPMARTDMME

SEQ ID NO: 3748 - protein, 53 aa, Canis lupus familiaris
KTMVSLLLVTRKHIIIPLERRSPQAHKSWMTAITKDTSLMKRFQMLASAHVGV

SEQ ID NO: 3749 - protein, 31 aa, Canis lupus familiaris
KTNKITVTRKAPQVIFWIIPFWFPFKFKKEI

SEQ ID NO: 3750 - skipped

SEQ ID NO: 3751 - protein, 15 aa, Canis lupus familiaris
KTPPQEQQSTVGVIS

SEQ ID NO: 3752 - protein, 72 aa, Canis lupus familiaris
KTPSRPMFSTMRIMLTETSRQKRLRPGGCGRSTPERARLCQGGAGVEMSVRWPQPRRSTRPGWPASFALLAR

SEQ ID NO: 3753 - protein, 17 aa, Canis lupus familiaris
KTPWMNLELRLLNCCAL

SEQ ID NO: 3754 - protein, 13 aa, Canis lupus familiaris
KTQFLKYKSSRKR

SEQ ID NO: 3755 - protein, 11 aa, Canis lupus familiaris
KTQKDQYCPRI

SEQ ID NO: 3756 - protein, 10 aa, Canis lupus familiaris
KTQQKTLSPP

SEQ ID NO: 3757 - protein, 10 aa, Canis lupus familiaris
KTQWGQPLKE

SEQ ID NO: 3758 - protein, 9 aa, Canis lupus familiaris
KTRKHRHLY

SEQ ID NO: 3759 - protein, 32 aa, Canis lupus familiaris
KTRMFIPAAAAPPPAQWEPPAHTALLLKAPTL

SEQ ID NO: 3760 - protein, 13 aa, Canis lupus familiaris
KTRPRTVHGSFLR

SEQ ID NO: 3761 - protein, 10 aa, Canis lupus familiaris
KTSFRVLASS

SEQ ID NO: 3762 - protein, 8 aa, Canis lupus familiaris
KTSRIFPA

SEQ ID NO: 3763 - protein, 22 aa, Canis lupus familiaris
KTSRLNARKPNRRKKRLTATSA

SEQ ID NO: 3764 - protein, 11 aa, Canis lupus familiaris
KTSSIGTMRPL

SEQ ID NO: 3765 - protein, 24 aa, Canis lupus familiaris
KTSTTFSTRKALWKAPLRNAFSIS

SEQ ID NO: 3766 - skipped

SEQ ID NO: 3767 - protein, 11 aa, Canis lupus familiaris
KTTQTAGLRLS

SEQ ID NO: 3768 - protein, 11 aa, Canis lupus familiaris
KTTSQNPLSLE

SEQ ID NO: 3769 - protein, 10 aa, Canis lupus familiaris
KTVGRPHISC

SEQ ID NO: 3770 - protein, 15 aa, Canis lupus familiaris
KTVLSLVTTSRFVLN

SEQ ID NO: 3771 - protein, 13 aa, Canis lupus familiaris
KTVVTVQTMRLFL

SEQ ID NO: 3772 - protein, 14 aa, Canis lupus familiaris
KTVYRMTQKNQLCL

SEQ ID NO: 3773 - protein, 51 aa, Canis lupus familiaris
KVCFQSCQLWCVKVVGVWPLSYILIFCHLSANCLRPLQIQSWISSEISSPL

SEQ ID NO: 3774 - protein, 26 aa, Canis lupus familiaris
KVCKRRTEKKKKRIWGGSCGVGRPRG

SEQ ID NO: 3775 - protein, 8 aa, Canis lupus familiaris
KVGGSGHR

SEQ ID NO: 3776 - protein, 42 aa, Canis lupus familiaris
KVHRGRKSVGSRHHCLQEERDDGRSEFYNQPSWKQIHGSHPK

SEQ ID NO: 3777 - protein, 17 aa, Canis lupus familiaris
KVHRKRCKDITRKKKIS

SEQ ID NO: 3778 - protein, 14 aa, Canis lupus familiaris
KVILLLFVLRRKLK

SEQ ID NO: 3779 - protein, 26 aa, Canis lupus familiaris
KVKIWAETNLSCDPVGGSYIPARTVV

SEQ ID NO: 3780 - protein, 22 aa, Canis lupus familiaris
KVLCGSLPHCSQSLHQGYEQCV

SEQ ID NO: 3781 - protein, 10 aa, Canis lupus familiaris
KVLITQMMKH

SEQ ID NO: 3782 - protein, 28 aa, Canis lupus familiaris
KVLLSAGQRAPRVGALCTRFISTCSYQL

SEQ ID NO: 3783 - protein, 13 aa, Canis lupus familiaris
KVLNKTSSGWSPK

SEQ ID NO: 3784 - protein, 11 aa, Canis lupus familiaris
KVLRKTQKMKI

SEQ ID NO: 3785 - protein, 16 aa, Canis lupus familiaris
KVLTKSSWTSSDQDPL

SEQ ID NO: 3786 - protein, 8 aa, Canis lupus familiaris
KVQTQLHV

SEQ ID NO: 3787 - protein, 17 aa, Canis lupus familiaris
KVRGPGHLHDRGAKEVL

SEQ ID NO: 3788 - protein, 14 aa, Canis lupus familiaris
KVRLQVALHLPPGS

SEQ ID NO: 3789 - protein, 9 aa, Canis lupus familiaris
KVRPHLLIK

SEQ ID NO: 3790 - protein, 31 aa, Canis lupus familiaris
KVSVITMKLWEKHFKELNWNLVAWILNSKRM

SEQ ID NO: 3791 - protein, 22 aa, Canis lupus familiaris
KVTQKTEEKQKRSHRYNSRFLK

SEQ ID NO: 3792 - protein, 30 aa, Canis lupus familiaris
KVTRETTLIFLNWTNLEAGKKHLSQIQKRN

SEQ ID NO: 3793 - protein, 10 aa, Canis lupus familiaris
KVTRETTLIL

SEQ ID NO: 3794 - skipped

SEQ ID NO: 3795 - protein, 9 aa, Canis lupus familiaris
KWKTAMDLI

SEQ ID NO: 3796 - protein, 40 aa, Canis lupus familiaris
KWNGNHAKRSATHWHKWEKVQRRREADKCYPQGRKTRLHH

SEQ ID NO: 3797 - protein, 22 aa, Canis lupus familiaris
KWPLDQFLHFYTCPYFNCHCCP

SEQ ID NO: 3798 - protein, 12 aa, Canis lupus familiaris
KWPTPLRGIFNQ

SEQ ID NO: 3799 - skipped

SEQ ID NO: 3800 - protein, 33 aa, Canis lupus familiaris
KWVLICLGLYRQKFRKPLMLQENLFQMIFSLIF

SEQ ID NO: 3801 - protein, 35 aa, Canis lupus familiaris
KYDLGRSTCRTSFPDSYSCLDQSKSKCIHLSRTMG

SEQ ID NO: 3802 - protein, 9 aa, Canis lupus familiaris
KYDRKFLFI

SEQ ID NO: 3803 - protein, 8 aa, Canis lupus familiaris
KYERQSIR

SEQ ID NO: 3804 - protein, 17 aa, Canis lupus familiaris
KYFDIQNFQIHILHESC

SEQ ID NO: 3805 - protein, 28 aa, Canis lupus familiaris
KYFTSIEKRRYRRNQYLTRFKRTQVSLY

SEQ ID NO: 3806 - protein, 8 aa, Canis lupus familiaris
KYIPCSNL

SEQ ID NO: 3807 - protein, 9 aa, Canis lupus familiaris
KYIRERMSV

SEQ ID NO: 3808 - protein, 12 aa, Canis lupus familiaris
KYMMKKLLSSHT

SEQ ID NO: 3809 - protein, 16 aa, Canis lupus familiaris
KYQTTFHVQYCRWWFY

SEQ ID NO: 3810 - protein, 24 aa, Canis lupus familiaris
KYSVEKTLKKFLAEHQAGKGPENC

SEQ ID NO: 3811 - protein, 10 aa, Canis lupus familiaris
KYYRSTIIVV

SEQ ID NO: 3812 - protein, 13 aa, Canis lupus familiaris
MFCPCFSLFKFSH

SEQ ID NO: 3813 - protein, 10 aa, Canis lupus familiaris
MGNTFGKEDP

SEQ ID NO: 3814 - protein, 24 aa, Canis lupus familiaris
NAVRTAFNIRRKPEGSDLYPVRLI

SEQ ID NO: 3815 - protein, 16 aa, Canis lupus familiaris
NDFSSLAFSSYLMMKC

SEQ ID NO: 3816 - protein, 20 aa, Canis lupus familiaris
NDIPNEIRVKNGNKWSTYYI

SEQ ID NO: 3817 - protein, 57 aa, Canis lupus familiaris
NDLRKNKEQPAKTDPSRRRTGRRGGSTKAPTPTMEHRTGSTRAATGTETISICLTFI

SEQ ID NO: 3818 - protein, 28 aa, Canis lupus familiaris
NEGKIQEARRRFFWSFQSFTPTSAHSRS

SEQ ID NO: 3819 - protein, 9 aa, Canis lupus familiaris
NEHCRPMCQ

SEQ ID NO: 3820 - protein, 33 aa, Canis lupus familiaris
NEISIRASKSGMGTRTLQFKIDLKTRKRKKKKY

SEQ ID NO: 3821 - protein, 11 aa, Canis lupus familiaris
NENRQVYTCCN

SEQ ID NO: 3822 - protein, 10 aa, Canis lupus familiaris
NEWCKNAVLI

SEQ ID NO: 3823 - protein, 27 aa, Canis lupus familiaris
NFIHENFRIILKQMLYMTCLAPVKTSC

SEQ ID NO: 3824 - protein, 11 aa, Canis lupus familiaris
NFPKAICLLNS

SEQ ID NO: 3825 - protein, 10 aa, Canis lupus familiaris
NFQCRAATDV

SEQ ID NO: 3826 - protein, 10 aa, Canis lupus familiaris
NFSRAGVLLC

SEQ ID NO: 3827 - protein, 14 aa, Canis lupus familiaris
NGHLLLDYKRRLWN

SEQ ID NO: 3828 - protein, 10 aa, Canis lupus familiaris
NGKQQWILSK

SEQ ID NO: 3829 - protein, 15 aa, Canis lupus familiaris
NGSIKCSRTSSMQNF

SEQ ID NO: 3830 - protein, 18 aa, Canis lupus familiaris
NGVLKILPLVLVELCYRS

SEQ ID NO: 3831 - protein, 18 aa, Canis lupus familiaris
NHCSREENTGQRRKATKG

SEQ ID NO: 3832 - protein, 24 aa, Canis lupus familiaris
NHLLKKKSQALKTKSYLQQQNHQL

SEQ ID NO: 3833 - protein, 22 aa, Canis lupus familiaris
NHLNQILELKVSMEASYWESDL

SEQ ID NO: 3834 - protein, 15 aa, Canis lupus familiaris
NHNTKHCSRFKNNGK

SEQ ID NO: 3835 - protein, 19 aa, Canis lupus familiaris
NHQLRHPFHHPEKRAFVAP

SEQ ID NO: 3836 - protein, 13 aa, Canis lupus familiaris
NHRLHGVVRRCYY

SEQ ID NO: 3837 - protein, 10 aa, Canis lupus familiaris
NHYAGDEGIK

SEQ ID NO: 3838 - protein, 21 aa, Canis lupus familiaris
NHYSKRLRTTDDKHRKAKSGG

SEQ ID NO: 3839 - protein, 24 aa, Canis lupus familiaris
NIFSNLLWKYTWNGDLQGEKKCRM

SEQ ID NO: 3840 - protein, 19 aa, Canis lupus familiaris
NIKASSIPHFKYKRNWFAC

SEQ ID NO: 3841 - protein, 23 aa, Canis lupus familiaris
NIQKQPPTSMLIIALLPNCCQME

SEQ ID NO: 3842 - protein, 50 aa, Canis lupus familiaris
NISSSKIIYPRVSQTQEVQEIPQKKAEKKVTQKTEEKQKRSHRYNSRFLK

SEQ ID NO: 3843 - protein, 37 aa, Canis lupus familiaris
NISTGRGLFLNAKIKKLYTQLLPYEKKIWKCLKHLDF

SEQ ID NO: 3844 - protein, 10 aa, Canis lupus familiaris
NITSKSMFLQ

SEQ ID NO: 3845 - protein, 18 aa, Canis lupus familiaris
NKEISRFGMHSSTLHGPW

SEQ ID NO: 3846 - protein, 15 aa, Canis lupus familiaris
NKGVQQSSSHYTVHI

SEQ ID NO: 3847 - protein, 21 aa, Canis lupus familiaris
NKKPIIKCLERKMELIKRMMN

SEQ ID NO: 3848 - protein, 11 aa, Canis lupus familiaris
NKKRLLKIRYH

SEQ ID NO: 3849 - protein, 11 aa, Canis lupus familiaris
NKNCGRKWRRS

SEQ ID NO: 3850 - protein, 14 aa, Canis lupus familiaris
NLAGFQEYMADWGI

SEQ ID NO: 3851 - protein, 8 aa, Canis lupus familiaris
NLGSFKGK

SEQ ID NO: 3852 - protein, 9 aa, Canis lupus familiaris
NLGSRILIY

SEQ ID NO: 3853 - protein, 13 aa, Canis lupus familiaris
NLIWQVFLKMILG

SEQ ID NO: 3854 - protein, 13 aa, Canis lupus familiaris
NLKTTTKLMKRAK

SEQ ID NO: 3855 - protein, 19 aa, Canis lupus familiaris
NLLLAIVQEIMSKKFVLKE

SEQ ID NO: 3856 - protein, 11 aa, Canis lupus familiaris
NLLPSFKMKEL

SEQ ID NO: 3857 - protein, 18 aa, Canis lupus familiaris
NLLRKWFPLIRKENLLSP

SEQ ID NO: 3858 - protein, 10 aa, Canis lupus familiaris
NLNILEEKRL

SEQ ID NO: 3859 - skipped

SEQ ID NO: 3860 - protein, 15 aa, Canis lupus familiaris
NLRLYPVPANRGGAV

SEQ ID NO: 3861 - protein, 58 aa, Canis lupus familiaris
NLSMSGIKPGRVRGVPLTLRNSCLGYKGSRNAEITMKFWEFLEMPVMKSLRKLIENLP

SEQ ID NO: 3862 - protein, 9 aa, Canis lupus familiaris
NLTGQNREI

SEQ ID NO: 3863 - protein, 17 aa, Canis lupus familiaris
NLVKRGGKFLEKGPPVK

SEQ ID NO: 3864 - protein, 17 aa, Canis lupus familiaris
NLWLIVLTQLVLNLVQE

SEQ ID NO: 3865 - protein, 14 aa, Canis lupus familiaris
NLYLEYKGGSKASI

SEQ ID NO: 3866 - protein, 12 aa, Canis lupus familiaris
NLYLYFSGQRIK

SEQ ID NO: 3867 - protein, 45 aa, Canis lupus familiaris
NMCWSPDCRRLGIDSSSLCPGQKFPGHSWSSLNHQEGVGKTDNVC

SEQ ID NO: 3868 - skipped

SEQ ID NO: 3869 - protein, 17 aa, Canis lupus familiaris
NMHTTHKMKKTTERKTK

SEQ ID NO: 3870 - protein, 29 aa, Canis lupus familiaris
NMKKTLQPITKISSIENIKNIINSIMIFL

SEQ ID NO: 3871 - protein, 24 aa, Canis lupus familiaris
NMKQRTCLSKVISEMFQKYLMLKL

SEQ ID NO: 3872 - protein, 36 aa, Canis lupus familiaris
NPAIKEKTQISRIDALLILMTLLTHIKDCLVQNIQP

SEQ ID NO: 3873 - protein, 24 aa, Canis lupus familiaris
NPFTGTLPVNRSLGRTILCLGGKV

SEQ ID NO: 3874 - protein, 9 aa, Canis lupus familiaris
NPRVNGKKS

SEQ ID NO: 3875 - protein, 9 aa, Canis lupus familiaris
NPRVNVKKS

SEQ ID NO: 3876 - skipped

SEQ ID NO: 3877 - protein, 17 aa, Canis lupus familiaris
NPSPAEGASLREERFII

SEQ ID NO: 3878 - protein, 24 aa, Canis lupus familiaris
NPTMFFSFMLCLQLGMLWRIRWRL

SEQ ID NO: 3879 - skipped

SEQ ID NO: 3880 - protein, 55 aa, Canis lupus familiaris
NQFEERGRGKKESARNPVPVGLAQSGESICLYKIRRRVNVPAKTQTRVARRGSLS

SEQ ID NO: 3881 - protein, 34 aa, Canis lupus familiaris
NQILVSLSSRTSKAPFPHGGIDQTSQPSPDQRGA

SEQ ID NO: 3882 - skipped

SEQ ID NO: 3883 - protein, 16 aa, Canis lupus familiaris
NQKPKKLRKLSGIGSL

SEQ ID NO: 3884 - protein, 29 aa, Canis lupus familiaris
NQKQMRTSQTLTWKIIVLILMTVTLFRED

SEQ ID NO: 3885 - protein, 16 aa, Canis lupus familiaris
NQKQRFPILNIQIDLL

SEQ ID NO: 3886 - protein, 8 aa, Canis lupus familiaris
NQLLKQPL

SEQ ID NO: 3887 - protein, 10 aa, Canis lupus familiaris
NQLTRDWKAL

SEQ ID NO: 3888 - protein, 59 aa, Canis lupus familiaris
NQQLQSPHTPLVFSFTWLSNTLQINVCLSKKFIAGFWTASHILLLHQQAGRILFDIICP

SEQ ID NO: 3889 - protein, 9 aa, Canis lupus familiaris
NQREGAKKL

SEQ ID NO: 3890 - protein, 11 aa, Canis lupus familiaris
NRCHAHPNSGN

SEQ ID NO: 3891 - protein, 23 aa, Canis lupus familiaris
NRGGKIHQHCTSHLLYQVCFQNI

SEQ ID NO: 3892 - protein, 10 aa, Canis lupus familiaris
NRGWKKSNLF

SEQ ID NO: 3893 - protein, 38 aa, Canis lupus familiaris
NRKGRLVEKMKTLVKKSLKKMKMILTTSLKMNFQKMRK

SEQ ID NO: 3894 - protein, 21 aa, Canis lupus familiaris
NRPWDKTILDSVAMELLTHSG

SEQ ID NO: 3895 - protein, 29 aa, Canis lupus familiaris
NRRVLQNLPTGRKLKEQLIPSRVETLMFQ

SEQ ID NO: 3896 - protein, 16 aa, Canis lupus familiaris
NRSYLCNESCEKRAGQ

SEQ ID NO: 3897 - protein, 13 aa, Canis lupus familiaris
NRYKRREETSRRQ

SEQ ID NO: 3898 - protein, 18 aa, Canis lupus familiaris
NSAQNLFTEIILSLPKHQ

SEQ ID NO: 3899 - protein, 25 aa, Canis lupus familiaris
NSDKKFLKISKKKPKKTTNLVSCMD

SEQ ID NO: 3900 - protein, 11 aa, Canis lupus familiaris
NSGQGHKGYKG

SEQ ID NO: 3901 - protein, 14 aa, Canis lupus familiaris
NSGSQVGMKMKATL

SEQ ID NO: 3902 - protein, 28 aa, Canis lupus familiaris
NSKKPLKRKRTNGLKMSMNGPEGKHWSG

SEQ ID NO: 3903 - protein, 9 aa, Canis lupus familiaris
NSKMTQIIQ

SEQ ID NO: 3904 - protein, 10 aa, Canis lupus familiaris
NSKSSQSVSV

SEQ ID NO: 3905 - protein, 14 aa, Canis lupus familiaris
NSLFKERPLKGQGI

SEQ ID NO: 3906 - protein, 9 aa, Canis lupus familiaris
NSLNEKLKI

SEQ ID NO: 3907 - skipped

SEQ ID NO: 3908 - protein, 28 aa, Canis lupus familiaris
NSRRRSGRRKREQNQKKLPLLYLQPSSK

SEQ ID NO: 3909 - protein, 70 aa, Canis lupus familiaris
NSRRRSGRRKREQNQKKLPLLYLQPSSKAQPKNCQDQAVSWPLLGRKFQLVEVKLNFVLNGGLSRRLSGP

SEQ ID NO: 3910 - protein, 8 aa, Canis lupus familiaris
NSSQDGHQ

SEQ ID NO: 3911 - protein, 12 aa, Canis lupus familiaris
NSSSIPFFLKNA

SEQ ID NO: 3912 - protein, 17 aa, Canis lupus familiaris
NSTAFLNIVLLHLTGNA

SEQ ID NO: 3913 - protein, 16 aa, Canis lupus familiaris
NSVCHFFVFLFGDIAG

SEQ ID NO: 3914 - protein, 12 aa, Canis lupus familiaris
NTAEFPKHPRSL

SEQ ID NO: 3915 - protein, 15 aa, Canis lupus familiaris
NTGLHMVTRLLILKS

SEQ ID NO: 3916 - protein, 11 aa, Canis lupus familiaris
NTKIFKINWKR

SEQ ID NO: 3917 - protein, 15 aa, Canis lupus familiaris
NTLQLKMGTLLQTLK

SEQ ID NO: 3918 - protein, 15 aa, Canis lupus familiaris
NTTEVQSLSCENLHF

SEQ ID NO: 3919 - protein, 14 aa, Canis lupus familiaris
NVECGICLSGNSKV

SEQ ID NO: 3920 - protein, 9 aa, Canis lupus familiaris
NVEITSAAI

SEQ ID NO: 3921 - protein, 30 aa, Canis lupus familiaris
NVKNPKAILIFLMKKQPCRIKRREVHGLPL

SEQ ID NO: 3922 - protein, 9 aa, Canis lupus familiaris
NVLPLFLTV

SEQ ID NO: 3923 - protein, 16 aa, Canis lupus familiaris
NVLQLRRNSFRYRNHG

SEQ ID NO: 3924 - protein, 11 aa, Canis lupus familiaris
NVPLTKLSEVF

SEQ ID NO: 3925 - protein, 10 aa, Canis lupus familiaris
NVSHWMRWDD

SEQ ID NO: 3926 - protein, 10 aa, Canis lupus familiaris
NVSQEKTESL

SEQ ID NO: 3927 - protein, 24 aa, Canis lupus familiaris
NWKELHSRENFLNGCLCRMRHVLQ

SEQ ID NO: 3928 - protein, 16 aa, Canis lupus familiaris
NWKRQLSQREDTRNNG

SEQ ID NO: 3929 - protein, 18 aa, Canis lupus familiaris
NWMWQFWRITIREKFIYK

SEQ ID NO: 3930 - protein, 8 aa, Canis lupus familiaris
NWWFFRSG

SEQ ID NO: 3931 - protein, 44 aa, Canis lupus familiaris
NYDYRLQWCRLLLIMHQILGMFQILSRKRYQLCWVLMVSVLLHH

SEQ ID NO: 3932 - protein, 10 aa, Canis lupus familiaris
NYKRPWINQP

SEQ ID NO: 3933 - protein, 18 aa, Canis lupus familiaris
NYLQKHYCEYERCATITS

SEQ ID NO: 3934 - protein, 19 aa, Canis lupus familiaris
NYRKLYQRQLEKRIKPLCS

SEQ ID NO: 3935 - protein, 28 aa, Canis lupus familiaris
NYSTLQISQKGRIYSRAAKDYQWEDKEK

SEQ ID NO: 3936 - protein, 11 aa, Canis lupus familiaris
RCKLSYMSKIL

SEQ ID NO: 3937 - protein, 23 aa, Canis lupus familiaris
RCKRFGVWKQTTKIGEKEREKEA

SEQ ID NO: 3938 - protein, 17 aa, Canis lupus familiaris
REKEETEGREASRPSWG

SEQ ID NO: 3939 - protein, 8 aa, Canis lupus familiaris
RELVKVGC

SEQ ID NO: 3940 - protein, 16 aa, Canis lupus familiaris
RENGGIFIRRSKYKCS

SEQ ID NO: 3941 - skipped

SEQ ID NO: 3942 - protein, 21 aa, Canis lupus familiaris
RENIYPETETYTDVHRRKSMS

SEQ ID NO: 3943 - protein, 23 aa, Canis lupus familiaris
RETGQFRRKGREETISFSSYWSF

SEQ ID NO: 3944 - protein, 15 aa, Canis lupus familiaris
RETGQFRRKGREETS

SEQ ID NO: 3945 - protein, 21 aa, Canis lupus familiaris
RETGQFRRKGREETVLGQAQI

SEQ ID NO: 3946 - protein, 12 aa, Canis lupus familiaris
RFKKGQGVSYRI

SEQ ID NO: 3947 - protein, 47 aa, Canis lupus familiaris
RFQFIGADGNSGSWLWMPRRLSYISQSIFQWTEFHCFSSENVFLRWL

SEQ ID NO: 3948 - protein, 35 aa, Canis lupus familiaris
RGSRSKTRSKSFRKEKNSRENKRERTATEEKARRN

SEQ ID NO: 3949 - protein, 39 aa, Canis lupus familiaris
RGTTRTKRKDFRATGFGRMYRYLTDQTGCNFTFFCVNHS

SEQ ID NO: 3950 - protein, 26 aa, Canis lupus familiaris
RIKASCYPEPFWRRNWWQWKTRWQER

SEQ ID NO: 3951 - protein, 23 aa, Canis lupus familiaris
RIYMQNGSRSSCSKGALRKRTKS

SEQ ID NO: 3952 - protein, 22 aa, Canis lupus familiaris
RKEKICRSSTGPIYKKNDSENC

SEQ ID NO: 3953 - protein, 21 aa, Canis lupus familiaris
RKETRNSSTSNETAASLQSSV

SEQ ID NO: 3954 - protein, 23 aa, Canis lupus familiaris
RLRRINGRGFKSRSRNAFSGSEE

SEQ ID NO: 3955 - protein, 18 aa, Canis lupus familiaris
RNQVDWLAYQFCSGMSKS

SEQ ID NO: 3956 - protein, 15 aa, Canis lupus familiaris
RNSQGLKSSTKQPTM

SEQ ID NO: 3957 - protein, 10 aa, Canis lupus familiaris
RNTSTSGSAS

SEQ ID NO: 3958 - protein, 12 aa, Canis lupus familiaris
RQENTDTFIENT

SEQ ID NO: 3959 - protein, 19 aa, Canis lupus familiaris
RRGLFFRRCERRKRGRAES

SEQ ID NO: 3960 - protein, 14 aa, Canis lupus familiaris
RRGRFQKRAECWLQ

SEQ ID NO: 3961 - protein, 35 aa, Canis lupus familiaris
RRPCATTCRKSRSIILQDTVLARLDKDPWQELPKL

SEQ ID NO: 3962 - protein, 17 aa, Canis lupus familiaris
RSCVFLSRTDGCFPSPC

SEQ ID NO: 3963 - protein, 17 aa, Canis lupus familiaris
RSKKISTRKNGRGPKGK

SEQ ID NO: 3964 - protein, 22 aa, Canis lupus familiaris
RSQTKIHRSPSVLRHLLFRTTS

SEQ ID NO: 3965 - protein, 10 aa, Canis lupus familiaris
RSSGSWASFL

SEQ ID NO: 3966 - protein, 15 aa, Canis lupus familiaris
RSSSAYCTGIAQCGY

SEQ ID NO: 3967 - protein, 22 aa, Canis lupus familiaris
RTKTFKAKRERRKGFTCTSYNY

SEQ ID NO: 3968 - protein, 26 aa, Canis lupus familiaris
RWRKCSTCERQNGPPACHFQRTENSF

SEQ ID NO: 3969 - protein, 12 aa, Canis lupus familiaris
RYQTKFPSIKNK

SEQ ID NO: 3970 - protein, 20 aa, Canis lupus familiaris
SCTRRKSKRPCLCRAFEEVQ

SEQ ID NO: 3971 - protein, 43 aa, Canis lupus familiaris
SEHGGGGHPLPCPPAGAVPASWRGQAPSDPACHGEQRDPVPFL

SEQ ID NO: 3972 - protein, 12 aa, Canis lupus familiaris
SEIGRKKLNSIW

SEQ ID NO: 3973 - protein, 17 aa, Canis lupus familiaris
SESQKTCPQKNSAQTSS

SEQ ID NO: 3974 - protein, 8 aa, Canis lupus familiaris
SHSLPTIL

SEQ ID NO: 3975 - protein, 8 aa, Canis lupus familiaris
SKKADGTA

SEQ ID NO: 3976 - protein, 32 aa, Canis lupus familiaris
SKRKLFLAFWLTVETSLLAVMYMFFGIFSGCI

SEQ ID NO: 3977 - protein, 29 aa, Canis lupus familiaris
SKTESSEFSRTTNYSSFILDQPYPSFTLA

SEQ ID NO: 3978 - protein, 10 aa, Canis lupus familiaris
SQIKDQYNGT

SEQ ID NO: 3979 - protein, 14 aa, Canis lupus familiaris
SQSGVQSWVQQEQC

SEQ ID NO: 3980 - protein, 12 aa, Canis lupus familiaris
SRKCSKTSRKEK

SEQ ID NO: 3981 - protein, 20 aa, Canis lupus familiaris
SSHLQKQRIIPSGKRTSMFS

SEQ ID NO: 3982 - protein, 9 aa, Canis lupus familiaris
SSHLQVLFL

SEQ ID NO: 3983 - protein, 11 aa, Canis lupus familiaris
SSLWLLVSLCT

SEQ ID NO: 3984 - protein, 15 aa, Canis lupus familiaris
SSPERGSSCEGQDRV

SEQ ID NO: 3985 - protein, 13 aa, Canis lupus familiaris
SSTRRTWRGNRQS

SEQ ID NO: 3986 - protein, 18 aa, Canis lupus familiaris
SSWSRQTSSNTFLQISRR

SEQ ID NO: 3987 - protein, 69 aa, Canis lupus familiaris
STKDVQPASSQPASQQHPLTVHIPYCVSPTRFPHTTKVHAAAILPGAVYALQESPIWLHAGTGENHSPG

SEQ ID NO: 3988 - protein, 52 aa, Canis lupus familiaris
TAEEEAEGGKGSRTRKNCPCCTCSPAARPSQRTARTRQSVGHCWGESSNWSK

SEQ ID NO: 3989 - protein, 53 aa, Canis lupus familiaris
TAEEEAEGGKGSRTRKNCPCCTCSPAASRPSQRTARTRQSVGHCWGESSNWSK

SEQ ID NO: 3990 - protein, 11 aa, Canis lupus familiaris
TAPKIYSQRSY

SEQ ID NO: 3991 - skipped

SEQ ID NO: 3992 - protein, 16 aa, Canis lupus familiaris
TDPGTKRYWIQLRWNC

SEQ ID NO: 3993 - protein, 11 aa, Canis lupus familiaris
TEAQAPEVNRS

SEQ ID NO: 3994 - protein, 23 aa, Canis lupus familiaris
TEDHTKGEEIQISSQSAHCDSGR

SEQ ID NO: 3995 - protein, 24 aa, Canis lupus familiaris
TEDHTKGEQEIQISSQSAHCDSGR

SEQ ID NO: 3996 - protein, 24 aa, Canis lupus familiaris
TEEERYTSTAHPTFYTRCAFRTFN

SEQ ID NO: 3997 - protein, 13 aa, Canis lupus familiaris
TEESYKTYPQEEN

SEQ ID NO: 3998 - protein, 16 aa, Canis lupus familiaris
TEQRPAAVFLGKSSAV

SEQ ID NO: 3999 - protein, 13 aa, Canis lupus familiaris
TGGRICKQKQVYF

SEQ ID NO: 4000 - protein, 8 aa, Canis lupus familiaris
THPFKAPL

SEQ ID NO: 4001 - protein, 25 aa, Canis lupus familiaris
TLAASRGSDSSKATREQPSRGDSAL

SEQ ID NO: 4002 - protein, 25 aa, Canis lupus familiaris
TLPYKSKQYILPKTQISEGWRGAPE

SEQ ID NO: 4003 - protein, 8 aa, Canis lupus familiaris
TNGAKTPF

SEQ ID NO: 4004 - protein, 8 aa, Canis lupus familiaris
TPYSKRDH

SEQ ID NO: 4005 - protein, 12 aa, Canis lupus familiaris
TQQSRKKPKYPE

SEQ ID NO: 4006 - protein, 25 aa, Canis lupus familiaris
TRNNIKLQGGLYCDEELPSEGPEAI

SEQ ID NO: 4007 - protein, 22 aa, Canis lupus familiaris
TRRDAKLSKRRVPCSSKHRLAF

SEQ ID NO: 4008 - protein, 20 aa, Canis lupus familiaris
TSARRKPSHSDIFPRGCNLC

SEQ ID NO: 4009 - protein, 9 aa, Canis lupus familiaris
TSIANTRYY

SEQ ID NO: 4010 - protein, 8 aa, Canis lupus familiaris
TSSTKTSG

SEQ ID NO: 4011 - protein, 11 aa, Canis lupus familiaris
TTFLPSLFLLI

SEQ ID NO: 4012 - protein, 13 aa, Canis lupus familiaris
TTGSFIKGSWKKE

SEQ ID NO: 4013 - protein, 12 aa, Canis lupus familiaris
TTITGCSGADSY

SEQ ID NO: 4014 - protein, 23 aa, Canis lupus familiaris
TTYRSTIANTKDVPPLQANNYPD

SEQ ID NO: 4015 - protein, 53 aa, Canis lupus familiaris
TVPLEACHWPLFLPTTVPSFRCKRRPVCMLGRLSVPVETTTGGLQWYPGPTCW

SEQ ID NO: 4016 - protein, 40 aa, Canis lupus familiaris
TVQSSAQEPPPCRISEGPGRADFTPAGEVHHHRGEGVYGV

SEQ ID NO: 4017 - protein, 14 aa, Canis lupus familiaris
TYRYKGKQHSFFST

SEQ ID NO: 4018 - protein, 26 aa, Canis lupus familiaris
IEFQKPSHLFKGSHSTRLLCIWIFVG

SEQ ID NO: 4019 - protein, 10 aa, Canis lupus familiaris
IFKNKNSCKK

SEQ ID NO: 4020 - protein, 32 aa, Canis lupus familiaris
IGSHRRRKFCKGWNQTISKFFRICNQNSCFSH

SEQ ID NO: 4021 - protein, 8 aa, Canis lupus familiaris
IKYSASIP

SEQ ID NO: 4022 - protein, 14 aa, Canis lupus familiaris
IQGDFEALRREGCD

SEQ ID NO: 4023 - protein, 23 aa, Canis lupus familiaris
IQPCQQITERFYCRISNTILHSF

SEQ ID NO: 4024 - protein, 32 aa, Canis lupus familiaris
IRLSEQELTEFSLCSSEYQSWINGSVYRCQAR

SEQ ID NO: 4025 - protein, 14 aa, Canis lupus familiaris
ISSYHHATRCPRKS

SEQ ID NO: 4026 - protein, 11 aa, Canis lupus familiaris
ITKPSFRLKEL

SEQ ID NO: 4027 - protein, 25 aa, Canis lupus familiaris
ITQAAAHTWLSQSSCCGCLPQTCGG

SEQ ID NO: 4028 - protein, 84 aa, Canis lupus familiaris
IWTCHDPFFCLLHLWTHWGHPEFSVSSGSDKEDLFSLPSASRLHVPCMHWDRWLHPVFLAHLSTSQLRTEEDVLRKGAFAAPLS

SEQ ID NO: 4029 - protein, 47 aa, Canis lupus familiaris
IWTFSTRRRGRRRKTKWKHRTEVKEQTAPNIKESTTEPCRTLQTSSY

SEQ ID NO: 4030 - protein, 42 aa, Canis lupus familiaris
IWTFSTRRRGRRRKTKWKHRTEVKEQTAPNIKESTTEQSRIS

SEQ ID NO: 4031 - protein, 41 aa, Canis lupus familiaris
IWTFSTRRRGRRRKTKWKHRTEVKEQTAPNIKESTTESRIS

SEQ ID NO: 4032 - protein, 20 aa, Canis lupus familiaris
KAAERRHAELTQLLAQADEA

SEQ ID NO: 4033 - protein, 10 aa, Canis lupus familiaris
KAFKFSVQLD

SEQ ID NO: 4034 - protein, 11 aa, Canis lupus familiaris
KASTTSMRMKN

SEQ ID NO: 4035 - protein, 10 aa, Canis lupus familiaris
KCGTKATKTF

SEQ ID NO: 4036 - protein, 29 aa, Canis lupus familiaris
KCKSWKQNSGKNNRKGNVCKLRQPSCRLG

SEQ ID NO: 4037 - protein, 12 aa, Canis lupus familiaris
KCPCRTLQTSSY

SEQ ID NO: 4038 - protein, 26 aa, Canis lupus familiaris
KCRINSVTGTSSTVRNPHSIFSNEGC

SEQ ID NO: 4039 - protein, 73 aa, Canis lupus familiaris
KCRLHPRKVDTRHLPAVTKTAAATGAGLQTRRLRCRACRLLWARPERAAPALRQARCRPRPSGPSRMSNLQLR

SEQ ID NO: 4040 - protein, 19 aa, Canis lupus familiaris
KCSFRSWTIRKCWRKNWKR

SEQ ID NO: 4041 - protein, 9 aa, Canis lupus familiaris
KDFGYTPDI

SEQ ID NO: 4042 - protein, 36 aa, Canis lupus familiaris
KDFIKTVILVRQRHSQGKLSRKVDLKSHLRTLRNVP

SEQ ID NO: 4043 - protein, 18 aa, Canis lupus familiaris
KDIVNVACRNMKILKLIF

SEQ ID NO: 4044 - protein, 14 aa, Canis lupus familiaris
KDLLISIQMLPLLF

SEQ ID NO: 4045 - protein, 30 aa, Canis lupus familiaris
KEAFKKKTYTCALTTVKATETKAGKWNCWE

SEQ ID NO: 4046 - protein, 31 aa, Canis lupus familiaris
KECVLVGGGLVAELQQAWGWGQFLYLYSLRP

SEQ ID NO: 4047 - protein, 10 aa, Canis lupus familiaris
KEEEKEKNGG

SEQ ID NO: 4048 - protein, 14 aa, Canis lupus familiaris
KEEITSEKFSAWNF

SEQ ID NO: 4049 - protein, 13 aa, Canis lupus familiaris
KEEKQKHCFKAWG

SEQ ID NO: 4050 - protein, 76 aa, Canis lupus familiaris
KEKILKLKVNIFMKKKNSLAKGARKNSWLNQFKLRSKGMPRLHTLERKNLPWLPPALVKSFNRDPGCHKAARTQIN

SEQ ID NO: 4051 - skipped

SEQ ID NO: 4052 - protein, 39 aa, Canis lupus familiaris
KEKKNNANSPASVSNPTVTKQVFGMEEELQREGSIETLS

SEQ ID NO: 4053 - protein, 11 aa, Canis lupus familiaris
KERVLIKKQSL

SEQ ID NO: 4054 - protein, 15 aa, Canis lupus familiaris
KFPLIFPSYLMSYTM

SEQ ID NO: 4055 - protein, 15 aa, Canis lupus familiaris
KFPLRFPSYLMSYTM

SEQ ID NO: 4056 - protein, 60 aa, Canis lupus familiaris
KFQMLPLFLMPVLWSISLLRDSMIWSNAWLPFETPRLSRMGTILRMSVWEWLSWPSPTMP

SEQ ID NO: 4057 - protein, 35 aa, Canis lupus familiaris
KFRRRKATTVTAQIIALIVIHHSIRVTNFVKENYN

SEQ ID NO: 4058 - protein, 15 aa, Canis lupus familiaris
KFYFKYRGPANSVEL

SEQ ID NO: 4059 - protein, 11 aa, Canis lupus familiaris
KGARGQNYGSS

SEQ ID NO: 4060 - protein, 55 aa, Canis lupus familiaris
KGGGGCIISSPRWPSGSARSRCADDVSSTWASLGLFVLFSYAPALFSGGLLRSRS

SEQ ID NO: 4061 - skipped

SEQ ID NO: 4062 - protein, 25 aa, Canis lupus familiaris
KGILKRKRFYQIFIIPHQMCLVSLI

SEQ ID NO: 4063 - protein, 12 aa, Canis lupus familiaris
KGISMRILRVIC

SEQ ID NO: 4064 - protein, 13 aa, Canis lupus familiaris
KGLGNQCYLDLLL

SEQ ID NO: 4065 - protein, 28 aa, Canis lupus familiaris
KGLQVFSSTGLKETLQEPVSTDMASRGF

SEQ ID NO: 4066 - protein, 28 aa, Canis lupus familiaris
KGQAFGNFSADFSAPQVIQLRSLNHLLI

SEQ ID NO: 4067 - protein, 23 aa, Canis lupus familiaris
KGRSRRVVKWKEQKTYMLLLLLD

SEQ ID NO: 4068 - protein, 9 aa, Canis lupus familiaris
KGVQEKDGE

SEQ ID NO: 4069 - protein, 9 aa, Canis lupus familiaris
KHHLHLLPH

SEQ ID NO: 4070 - protein, 29 aa, Canis lupus familiaris
KHKYPHWLLMLAPPKKCLFPLLHLTLSCY

SEQ ID NO: 4071 - protein, 21 aa, Canis lupus familiaris
KHTLTLGKKLIQLLLLCCIKS

SEQ ID NO: 4072 - protein, 26 aa, Canis lupus familiaris
KIASISYPDGSVSSWLDREFWSTCCP

SEQ ID NO: 4073 - protein, 33 aa, Canis lupus familiaris
KIIIQGTVVKEMKEEFPGGMKIVKHQEIPWTQH

SEQ ID NO: 4074 - protein, 9 aa, Canis lupus familiaris
KILKNINLT

SEQ ID NO: 4075 - protein, 19 aa, Canis lupus familiaris
KINVLSHRGETSDLTALLR

SEQ ID NO: 4076 - protein, 44 aa, Canis lupus familiaris
KIPGPLRPCPPPLPASSPAAAAFAPHHVTLSRHRSPCWPLPAAR

SEQ ID NO: 4077 - protein, 26 aa, Canis lupus familiaris
KIQLLYLVNSLYNYLWRIQVKKMLQL

SEQ ID NO: 4078 - protein, 14 aa, Canis lupus familiaris
KIVAAGQTRPVSRS

SEQ ID NO: 4079 - protein, 11 aa, Canis lupus familiaris
KIWTVRNYLPH

SEQ ID NO: 4080 - protein, 94 aa, Canis lupus familiaris
KKKRKKKKKEKQGGGRGGRAVPAPGCPFGRRSCFSRFRARGGSRGGGLRARALPWRERAQITCIPRISAHFGHDRVSAMGQVSLAATNGRHKQG

SEQ ID NO: 4081 - protein, 12 aa, Canis lupus familiaris
KKLDVIRSPLNF

SEQ ID NO: 4082 - protein, 9 aa, Canis lupus familiaris
KKPLTLSPS

SEQ ID NO: 4083 - protein, 9 aa, Canis lupus familiaris
KKRKKMKFH

SEQ ID NO: 4084 - protein, 14 aa, Canis lupus familiaris
KKRNWQIRHLLKNL

SEQ ID NO: 4085 - protein, 20 aa, Canis lupus familiaris
KKRSRSIASKHGADSRIPHC

SEQ ID NO: 4086 - protein, 22 aa, Canis lupus familiaris
KKRSRSIASKHGADSRIPHCFF

SEQ ID NO: 4087 - protein, 35 aa, Canis lupus familiaris
KKRSRSIASKHGADSRIPHCPSSYVSILQICEHTK

SEQ ID NO: 4088 - protein, 12 aa, Canis lupus familiaris
KLERNRMERVKK

SEQ ID NO: 4089 - protein, 37 aa, Canis lupus familiaris
KLESCGRCKGRTQSEDYFETKESENSIWKQDKKQPDQ

SEQ ID NO: 4090 - protein, 17 aa, Canis lupus familiaris
KLKCNIKTLKIYISSSS

SEQ ID NO: 4091 - protein, 14 aa, Canis lupus familiaris
KLLQPCLKALSVPL

SEQ ID NO: 4092 - protein, 8 aa, Canis lupus familiaris
KLLSWNSL

SEQ ID NO: 4093 - protein, 16 aa, Canis lupus familiaris
KLMNILKQVPKSLGLT

SEQ ID NO: 4094 - protein, 25 aa, Canis lupus familiaris
KLRTICTSYVNPLIICTEMEYFTEM

SEQ ID NO: 4095 - protein, 37 aa, Canis lupus familiaris
KLSPPVPPISLWSLSIMAPLSLPMFTLQRSTTSPLVK

SEQ ID NO: 4096 - protein, 16 aa, Canis lupus familiaris
KLTETVYSTTQPTRSS

SEQ ID NO: 4097 - protein, 29 aa, Canis lupus familiaris
KLTHSYGFQASTLLLIGLARHWWIFHSTS

SEQ ID NO: 4098 - protein, 10 aa, Canis lupus familiaris
KLVMTLTLSG

SEQ ID NO: 4099 - protein, 50 aa, Canis lupus familiaris
KLVRLDLLMSCLKVIKRMKNVSPQKARTVKALNQWLKLLLFLIVQTLYHH

SEQ ID NO: 4100 - protein, 19 aa, Canis lupus familiaris
KMIRKALIKTRIQFRNYLK

SEQ ID NO: 4101 - protein, 24 aa, Canis lupus familiaris
KMLIQKLDHQEVLEKKLEEIILCL

SEQ ID NO: 4102 - protein, 25 aa, Canis lupus familiaris
KMLMLKKGNPHLIRLLPLEFIGADT

SEQ ID NO: 4103 - protein, 13 aa, Canis lupus familiaris
KMWNKSYKNFLIS

SEQ ID NO: 4104 - protein, 21 aa, Canis lupus familiaris
KNKWNGMVVLNKSLNHVHLLE

SEQ ID NO: 4105 - protein, 49 aa, Canis lupus familiaris
KPCGNSMWTKPSRLTPSPGLSSLSLSSSSTPSTGLSIKCYGQKIFTRHC

SEQ ID NO: 4106 - protein, 23 aa, Canis lupus familiaris
KPKSLVERVLEKWRKIPLKERKA

SEQ ID NO: 4107 - protein, 20 aa, Canis lupus familiaris
KPLRKSSQLRRSWRNASRIS

SEQ ID NO: 4108 - protein, 10 aa, Canis lupus familiaris
KPRLPWNIPC

SEQ ID NO: 4109 - protein, 14 aa, Canis lupus familiaris
KQRKIEILPKMFHF

SEQ ID NO: 4110 - protein, 27 aa, Canis lupus familiaris
KRGGGMYYFISQVAFRLSSIQMCRRCF

SEQ ID NO: 4111 - protein, 34 aa, Canis lupus familiaris
KRKEISVTPVYLYLLKSLATYWMKIWDPSLITLA

SEQ ID NO: 4112 - protein, 13 aa, Canis lupus familiaris
KRKKQQEKPLKRH

SEQ ID NO: 4113 - protein, 15 aa, Canis lupus familiaris
KRKMRSLSHPSRLTN

SEQ ID NO: 4114 - protein, 23 aa, Canis lupus familiaris
KRKRRLNQFLIIMKTLMVMVFMK

SEQ ID NO: 4115 - protein, 38 aa, Canis lupus familiaris
KRMCSGGRWPGGRAATSMGLGSVLVSLQLTSLMAATAT

SEQ ID NO: 4116 - skipped

SEQ ID NO: 4117 - protein, 60 aa, Canis lupus familiaris
KRRREREKWWMMLGLIPKNQKLKTKGTLKKGPRLLKRQKTMGRSQMMRKRTVKCPAYPWD

SEQ ID NO: 4118 - protein, 26 aa, Canis lupus familiaris
KRSKRTKLWFLLINILHGKNLWVLVR

SEQ ID NO: 4119 - protein, 23 aa, Canis lupus familiaris
KSAFATYKVKAAASVHPLQMEAY

SEQ ID NO: 4120 - protein, 8 aa, Canis lupus familiaris
KSKTSCVV

SEQ ID NO: 4121 - protein, 26 aa, Canis lupus familiaris
KSLQASDISGISGMYSGDHSSCQRLE

SEQ ID NO: 4122 - protein, 21 aa, Canis lupus familiaris
KSMCYHTVEKHQILLLFYVRT

SEQ ID NO: 4123 - protein, 27 aa, Canis lupus familiaris
KSPDRSGRVRRRFPHPLPPPPPSLLTM

SEQ ID NO: 4124 - protein, 15 aa, Canis lupus familiaris
KSQVIQCCLPVKSMI

SEQ ID NO: 4125 - protein, 12 aa, Canis lupus familiaris
KSSGKDFRMPCQ

SEQ ID NO: 4126 - protein, 17 aa, Canis lupus familiaris
KSSGTEACGTHPAPRPS

SEQ ID NO: 4127 - protein, 9 aa, Canis lupus familiaris
KSTQFLCVL

SEQ ID NO: 4128 - protein, 20 aa, Canis lupus familiaris
KSTTRIPMWPCTPWRSWSLW

SEQ ID NO: 4129 - protein, 11 aa, Canis lupus familiaris
KSVRNLPTALC

SEQ ID NO: 4130 - protein, 10 aa, Canis lupus familiaris
KSWLLARLAL

SEQ ID NO: 4131 - protein, 8 aa, Canis lupus familiaris
KTKVTRSP

SEQ ID NO: 4132 - protein, 39 aa, Canis lupus familiaris
KTRKKRKRRRRQKRPQPKTLTHYSRRKRRKRRRQQSKLS

SEQ ID NO: 4133 - protein, 20 aa, Canis lupus familiaris
KTVFKSAYTNISLMPWFKGK

SEQ ID NO: 4134 - protein, 32 aa, Canis lupus familiaris
KVCRRKMESDKVPRLPASISWCNKHRVDTGKL

SEQ ID NO: 4135 - protein, 11 aa, Canis lupus familiaris
KVFCDLPRRAP

SEQ ID NO: 4136 - protein, 13 aa, Canis lupus familiaris
KVFMTQKKVTSFL

SEQ ID NO: 4137 - protein, 25 aa, Canis lupus familiaris
KVIAIQSRMYREILNTHHRRKEIRK

SEQ ID NO: 4138 - protein, 16 aa, Canis lupus familiaris
KVKHLAIFQPTFQLLK

SEQ ID NO: 4139 - protein, 11 aa, Canis lupus familiaris
KVLKKQKAPCK

SEQ ID NO: 4140 - protein, 8 aa, Canis lupus familiaris
KVRSLHTR

SEQ ID NO: 4141 - protein, 18 aa, Canis lupus familiaris
KVTDKGRKRTPTWRRGFC

SEQ ID NO: 4142 - protein, 20 aa, Canis lupus familiaris
KVTGGSEWSYLMMKQKKLKI

SEQ ID NO: 4143 - protein, 11 aa, Canis lupus familiaris
KWESEPLPPVH

SEQ ID NO: 4144 - protein, 32 aa, Canis lupus familiaris
KWIHLMEAWLKPHLGTVVPRIVELAVTVLKSE

SEQ ID NO: 4145 - protein, 8 aa, Canis lupus familiaris
KWLITCVA

SEQ ID NO: 4146 - protein, 28 aa, Canis lupus familiaris
KWWWRRVYGKTPRGLDETLQIWPPGGRS

SEQ ID NO: 4147 - protein, 12 aa, Canis lupus familiaris
KYYRCAYRTGYL

SEQ ID NO: 4148 - protein, 23 aa, Canis lupus familiaris
MYFTVTRFFTDICLLRIRFKIYY

SEQ ID NO: 4149 - protein, 27 aa, Canis lupus familiaris
NAISLFWTWDVVKVEICSNGKREELTS

SEQ ID NO: 4150 - protein, 13 aa, Canis lupus familiaris
NARAFPYNQEKSI

SEQ ID NO: 4151 - protein, 20 aa, Canis lupus familiaris
NARVGSKTPGRTTGKETYAS

SEQ ID NO: 4152 - protein, 11 aa, Canis lupus familiaris
NERKVKRERIY

SEQ ID NO: 4153 - protein, 35 aa, Canis lupus familiaris
NFLHLCLPSHCGLYLLWHHYLCLCSPSSEAQLHHW

SEQ ID NO: 4154 - protein, 16 aa, Canis lupus familiaris
NGGRCNCRSSMQTQRG

SEQ ID NO: 4155 - protein, 13 aa, Canis lupus familiaris
NGNPSLFHLCINI

SEQ ID NO: 4156 - protein, 13 aa, Canis lupus familiaris
NHAETLCGPSQAD

SEQ ID NO: 4157 - protein, 8 aa, Canis lupus familiaris
NHVLILEI

SEQ ID NO: 4158 - protein, 48 aa, Canis lupus familiaris
NIETGSHLTLTAQTLRVTQARGQGTHQKTARQQRRRRRRRSIRRNTRS

SEQ ID NO: 4159 - protein, 48 aa, Canis lupus familiaris
NIGGKRLPVMLSRRAHLLGSPCPSRVRIRRSWKACFLWAQRAESHNYQ

SEQ ID NO: 4160 - protein, 47 aa, Canis lupus familiaris
NIICTFYPTDRTAIFTRKRSSHYSCCFSYSKCEPITEYCGWTEKCTK

SEQ ID NO: 4161 - skipped

SEQ ID NO: 4162 - protein, 22 aa, Canis lupus familiaris
NILVKRESKGLAGSRKLNQSRD

SEQ ID NO: 4163 - protein, 31 aa, Canis lupus familiaris
NIRKLIWTKQRSFLSSFPKLRATEQTTSAGC

SEQ ID NO: 4164 - protein, 12 aa, Canis lupus familiaris
NKCSTNSTIRTT

SEQ ID NO: 4165 - protein, 35 aa, Canis lupus familiaris
NKFDGKPQITCFRSGQGKRCGALCVQLHCVQAATR

SEQ ID NO: 4166 - protein, 76 aa, Canis lupus familiaris
NLDLQHQKKRKKKKDKVETQNRSQRANSTEHQGEHNRAEQNLLKLVQLNPHNPHHRKDEEDHQKRHHHHNQKKMSV

SEQ ID NO: 4167 - protein, 39 aa, Canis lupus familiaris
NLDLQHQKKRKKKKDKVETQNRSQRANSTEHQGEHNRAV

SEQ ID NO: 4168 - protein, 75 aa, Canis lupus familiaris
NLDLQHQKKRKKKKDKVETQNRSQRANSTEHQGEHNREQNLLKLVQLNPHNPHHRKDEEDHQKRHHHHNQKKMSV

SEQ ID NO: 4169 - protein, 29 aa, Canis lupus familiaris
NLHQKVLMRRLMEHIQRPSVVSGALPIHS

SEQ ID NO: 4170 - protein, 8 aa, Canis lupus familiaris
NLMKVGNK

SEQ ID NO: 4171 - protein, 80 aa, Canis lupus familiaris
NLRRMVRGFIPCWIGTYIYLPKRKNLSYKRQTSRWTRKGTISLSPLLIMFIKFRKFRSPRSSTLWSQCWPFFIASSFPTV

SEQ ID NO: 4172 - protein, 10 aa, Canis lupus familiaris
NLTFKILSFL

SEQ ID NO: 4173 - protein, 11 aa, Canis lupus familiaris
NLVMKGQTLGR

SEQ ID NO: 4174 - skipped

SEQ ID NO: 4175 - protein, 31 aa, Canis lupus familiaris
NPAMPTNYREVLLPHIQHNPPFLLKARLQQF

SEQ ID NO: 4176 - protein, 17 aa, Canis lupus familiaris
NPRAWWRGCWRNGERSP

SEQ ID NO: 4177 - protein, 28 aa, Canis lupus familiaris
NPRSKAKGTQRAKKPTQACIRYGKQACS

SEQ ID NO: 4178 - protein, 14 aa, Canis lupus familiaris
NQDCPGTSHVNRST

SEQ ID NO: 4179 - protein, 10 aa, Canis lupus familiaris
NQLSSSVFYE

SEQ ID NO: 4180 - protein, 13 aa, Canis lupus familiaris
NQTLKILFHPSLP

SEQ ID NO: 4181 - protein, 10 aa, Canis lupus familiaris
NRARKCRASL

SEQ ID NO: 4182 - protein, 21 aa, Canis lupus familiaris
NRRKRPTGRRNCDLGRSCRAF

SEQ ID NO: 4183 - protein, 13 aa, Canis lupus familiaris
NSEGEKQQQLLHR

SEQ ID NO: 4184 - protein, 36 aa, Canis lupus familiaris
NSFITTFQQRFFKRRKSKVFLMLVEVQVDLNPKDHL

SEQ ID NO: 4185 - protein, 24 aa, Canis lupus familiaris
NSLVIVEEQTFLVMDKLNYVPLAL

SEQ ID NO: 4186 - protein, 9 aa, Canis lupus familiaris
NSRKRKQKG

SEQ ID NO: 4187 - protein, 18 aa, Canis lupus familiaris
NSRSKSHFDDGIYSFGIF

SEQ ID NO: 4188 - protein, 10 aa, Canis lupus familiaris
NSTCTHKAGN

SEQ ID NO: 4189 - protein, 11 aa, Canis lupus familiaris
NSVDHIIAFWH

SEQ ID NO: 4190 - protein, 15 aa, Canis lupus familiaris
NSYHGTLYKQTSEFW

SEQ ID NO: 4191 - protein, 22 aa, Canis lupus familiaris
NTEHRLTMDSALSLTKREGPET

SEQ ID NO: 4192 - protein, 8 aa, Canis lupus familiaris
NTNTHIGC

SEQ ID NO: 4193 - protein, 15 aa, Canis lupus familiaris
NVFHSYQILYRHLSP

SEQ ID NO: 4194 - protein, 41 aa, Canis lupus familiaris
NVFVLFSEHLWSSSARHCSKLWGRGQKSELPARGSGPSRKK

SEQ ID NO: 4195 - protein, 11 aa, Canis lupus familiaris
NVSQNKKLVMY

SEQ ID NO: 4196 - protein, 9 aa, Canis lupus familiaris
NWKETEWKE

SEQ ID NO: 4197 - protein, 16 aa, Canis lupus familiaris
NWMNLSLPMMLTILIW

SEQ ID NO: 4198 - protein, 9 aa, Canis lupus familiaris
NYALYVPVM

SEQ ID NO: 4199 - protein, 64 aa, Canis lupus familiaris
NYASCSSHLAFPIQLLRMLTSNLWWMIPGDRFCGGNQIWTKLENFVSVILAGTGRRQMSLCFQY

SEQ ID NO: 4200 - protein, 54 aa, Canis lupus familiaris
NYASCSSHLAFPIQLLRMLTSNLWWMIPGDRFCGGNQIWTKLETLFWLEQDEDR

SEQ ID NO: 4201 - protein, 15 aa, Canis lupus familiaris
NYDGDCKSLHFKLEK

SEQ ID NO: 4202 - protein, 14 aa, Canis lupus familiaris
NYKEEVTISAWFNP

SEQ ID NO: 4203 - protein, 9 aa, Canis lupus familiaris
NYKKRGHFS

SEQ ID NO: 4204 - protein, 9 aa, Canis lupus familiaris
RGRSSKKSH

SEQ ID NO: 4205 - protein, 10 aa, Canis lupus familiaris
RKGIGRSDIY

SEQ ID NO: 4206 - protein, 12 aa, Canis lupus familiaris
RKKKTMPTAQRP

SEQ ID NO: 4207 - protein, 34 aa, Canis lupus familiaris
RNNESRGWNEIQKPNPETWGISGRHGHAPEFLET

SEQ ID NO: 4208 - protein, 41 aa, Canis lupus familiaris
RNNESRGWNEIQKPNPETWGISGRHGHAPEFLETSEHRVLV

SEQ ID NO: 4209 - protein, 12 aa, Canis lupus familiaris
RPFSSQPIQIYL

SEQ ID NO: 4210 - protein, 19 aa, Canis lupus familiaris
RQGKKGKEEEGKKGLNQRP

SEQ ID NO: 4211 - protein, 26 aa, Canis lupus familiaris
RSRIESFTKYQQQQQFYSWDSKSATL

SEQ ID NO: 4212 - protein, 21 aa, Canis lupus familiaris
RSSATCQEGLHESRSRWPCIS

SEQ ID NO: 4213 - protein, 17 aa, Canis lupus familiaris
RSSATCQEGLHESSGSR

SEQ ID NO: 4214 - protein, 9 aa, Canis lupus familiaris
RTNGTGWLF

SEQ ID NO: 4215 - protein, 8 aa, Canis lupus familiaris
RVWGTSVT

SEQ ID NO: 4216 - protein, 22 aa, Canis lupus familiaris
SITDALTEQVICELAITDWNGL

SEQ ID NO: 4217 - protein, 49 aa, Canis lupus familiaris
SKSRFASRSKAQYSSQKDSRRENEEADAERRVLAKTRRRRTLENGNEAL

SEQ ID NO: 4218 - protein, 22 aa, Canis lupus familiaris
SQAERTSECHVSEASTHHKVCS

SEQ ID NO: 4219 - protein, 15 aa, Canis lupus familiaris
SQKDKSPDELQSQGI

SEQ ID NO: 4220 - protein, 12 aa, Canis lupus familiaris
SQRPPVSSNWSG

SEQ ID NO: 4221 - protein, 40 aa, Canis lupus familiaris
SQRQESPCGLVRPGGHGVCGEELWPDGARRGGQQADHGGA

SEQ ID NO: 4222 - protein, 41 aa, Canis lupus familiaris
SSLTATDFRPLPFCLLVWPGTGGYSTLLLDPPSNANNGLCF

SEQ ID NO: 4223 - protein, 8 aa, Canis lupus familiaris
SSRCYPSS

SEQ ID NO: 4224 - protein, 16 aa, Canis lupus familiaris
SVAFIQERWTRVTCRQ

SEQ ID NO: 4225 - protein, 31 aa, Canis lupus familiaris
TADHRDFLSSTSPWQLPLGHPAISLLCFLLI

SEQ ID NO: 4226 - protein, 23 aa, Canis lupus familiaris
TAGRGSRKAEAYSRRNGKRKKKT

SEQ ID NO: 4227 - protein, 20 aa, Canis lupus familiaris
TASSLPSSRDSSKEEKAKSF

SEQ ID NO: 4228 - protein, 22 aa, Canis lupus familiaris
TGGTETSARCKEKETRNFRKAH

SEQ ID NO: 4229 - protein, 10 aa, Canis lupus familiaris
TKGCRKAICL

SEQ ID NO: 4230 - protein, 19 aa, Canis lupus familiaris
TLSFQSIECSCLKCFKRSC

SEQ ID NO: 4231 - protein, 16 aa, Canis lupus familiaris
TNRDFRYTNHESFKRT

SEQ ID NO: 4232 - skipped

SEQ ID NO: 4233 - protein, 28 aa, Canis lupus familiaris
TQLHFAAESIIIIQLWKALAHSSCHLGA

SEQ ID NO: 4234 - protein, 11 aa, Canis lupus familiaris
TRYHCFGPGMW

SEQ ID NO: 4235 - protein, 8 aa, Canis lupus familiaris
TSEERGFL

SEQ ID NO: 4236 - protein, 24 aa, Canis lupus familiaris
TTRKEAIFPENFGRKGLDWTSQST

SEQ ID NO: 4237 - protein, 10 aa, Canis lupus familiaris
HRRVPLVATP

SEQ ID NO: 4238 - protein, 64 aa, Canis lupus familiaris
PAALTGDFSPHPDRDPRSHRGPQLPHRPYSHRRPQPPPRPPLSTWPLHPAFAALSPLRLRLTPG

SEQ ID NO: 4239-4242 - skipped (4 entries)

SEQ ID NO: 4243 - protein, 35 aa, Canis lupus familiaris
PAPSLVPEPRARRPARPARPGTGQQQQQQEGHLHG

SEQ ID NO: 4244 - skipped

SEQ ID NO: 4245 - protein, 34 aa, Canis lupus familiaris
PCCPPAPPSPPPSSPAGPRPRGAAPGVCGRGRGG

SEQ ID NO: 4246 - protein, 80 aa, Canis lupus familiaris
PCGGAPRPAAATGEKRDTDGLPRAWGLRRPVNTGMGAASAHGARGGRRRGRQGQPGQRPSAPITAGAASWPRVRPRQEPP

SEQ ID NO: 4247 - skipped

SEQ ID NO: 4248 - protein, 18 aa, Canis lupus familiaris
PEPAWCWPECPGAIQWSW

SEQ ID NO: 4249 - protein, 15 aa, Canis lupus familiaris
PGGPILIGNSSAKSL

SEQ ID NO: 4250 - protein, 21 aa, Canis lupus familiaris
PGPGGPHTRRGCGRRACGTPI

SEQ ID NO: 4251 - protein, 92 aa, Canis lupus familiaris
PGTGRAPHAAWVWQACLWDTHLTRSRCGCRCRARRSLSTGGPCTASSPSSSRRACWACTRAWARRSWGSRSSTRWCSACRATPCGRWAATRR

SEQ ID NO: 4252 - protein, 87 aa, Canis lupus familiaris
PHCPWLWCRPSWKGRGTSAPRGPGMPNSLNQGVPGRYLTGGLWAWTGGHEAQRICCLPCCFGPPLKVWSLQGPWMCWAPAIKGENGP

SEQ ID NO: 4253 - protein, 38 aa, Canis lupus familiaris
PHSPSLHASPLRRAPTPAGVGVGAPPRFPQKKKTRTRT

SEQ ID NO: 4254 - protein, 48 aa, Canis lupus familiaris
PKASWREWLCADPGGWARCPREECPVAHRSQKTGHVPGPLPQQRPRTP

SEQ ID NO: 4255 - protein, 66 aa, Canis lupus familiaris
PLLGILGLGRRLPPAAGLPVTGSPRSFTDTITYRDSRFLRPSKRPSWYNILTVNRPVVILARTQTT

SEQ ID NO: 4256 - protein, 44 aa, Canis lupus familiaris
PLLPPGPSIPAPLLPCRTPTPRGCSWGLRQGARRMRGWRPSRRF

SEQ ID NO: 4257 - protein, 17 aa, Canis lupus familiaris
PLPHPAGSNSRGCSESC

SEQ ID NO: 4258 - protein, 13 aa, Canis lupus familiaris
PLRRRPQARSSDR

SEQ ID NO: 4259 - protein, 16 aa, Canis lupus familiaris
PLTSPPPFSPCSQYFI

SEQ ID NO: 4260 - protein, 35 aa, Canis lupus familiaris
PPAPDSQAEGRCRPKDGRELQSPVYRGEGLRLQRF

SEQ ID NO: 4261 - protein, 60 aa, Canis lupus familiaris
PPLSPAISAPTRTATPALTADPSSHTDPTLTADLSPHPDPRFQPGLSTPPSPPCLRCVCV

SEQ ID NO: 4262 - protein, 83 aa, Canis lupus familiaris
PPPAQLEQLARRAQRARGHRALPPRRAEQPVCAAAGGAALGGEQPSPSDLHAGLRLPAGAAGGHAGTLGGGVLPAPRAGEEPG

SEQ ID NO: 4263 - protein, 36 aa, Canis lupus familiaris
PPQSPPRGHPLKLSPASVSSQAWNPAASMKLPSTPS

SEQ ID NO: 4264 - protein, 11 aa, Canis lupus familiaris
PQGFVEGVALC

SEQ ID NO: 4265 - protein, 17 aa, Canis lupus familiaris
PQTPSHRLSRPSRCRCP

SEQ ID NO: 4266 - protein, 54 aa, Canis lupus familiaris
PRPLPGPRAPSQAPSPPCTSRHRPTTATTRGAPSRMTCTSWWTSGRARRRGPPS

SEQ ID NO: 4267 - protein, 21 aa, Canis lupus familiaris
PRRDPAPVGGSRTFPRFSPGM

SEQ ID NO: 4268 - protein, 31 aa, Canis lupus familiaris
PRRPHGPRTTPPGRPAPAAWCPGAAQAGGLP

SEQ ID NO: 4269 - protein, 33 aa, Canis lupus familiaris
PRRRGPQGQPRHIPAPGEGPHRPLRGPQLRPAR

SEQ ID NO: 4270 - protein, 80 aa, Canis lupus familiaris
PRVPPPALPPWTSDPTLLGHISAPPTPTRAPRTQTARSPPPPPTPPPCCPPAPPSPPPSSPAGPRPRGAAPGVCGRGRGG

SEQ ID NO: 4271 - protein, 17 aa, Canis lupus familiaris
PSARGRSRAAAAAAAAS

SEQ ID NO: 4272 - protein, 23 aa, Canis lupus familiaris
PSGLVPWGGPRHAAPLRVWGLLF

SEQ ID NO: 4273 - protein, 8 aa, Canis lupus familiaris
PSGSRLTS

SEQ ID NO: 4274 - protein, 30 aa, Canis lupus familiaris
PSSASSASAAASPLRRDCLSRGAREVLRIR

SEQ ID NO: 4275 - protein, 56 aa, Canis lupus familiaris
PTAPSRGIQLPRLQRVLLTRPPRPPRPPGSHSPREQAEPVGAQGRCSLATCRQALG

SEQ ID NO: 4276 - protein, 13 aa, Canis lupus familiaris
PTGSPPRAAPLDK

SEQ ID NO: 4277 - protein, 28 aa, Canis lupus familiaris
PTVRGCGAGHPGREGELQPRGAQECPTA

SEQ ID NO: 4278-4279 - skipped (2 entries)

SEQ ID NO: 4280 - protein, 81 aa, Canis lupus familiaris
RPRGSEKHELLEVLPFRSRPAQRAHPADGLSQPVAPAAELGEAEWPRPEAREAARLRGRPRREGGFPVGQHLAVARGQRPL

SEQ ID NO: 4281-4282 - skipped (2 entries)

SEQ ID NO: 4283 - protein, 86 aa, Canis lupus familiaris
PASRAVPLPDARSGLSETRHAARQPNDTSGTFHGTPWLWGEPFSPTWPGPVRDGPVPQETCTSADTAGPAAGGPKSKPQCKEKEDG

SEQ ID NO: 4284 - skipped

SEQ ID NO: 4285 - protein, 12 aa, Canis lupus familiaris
PEPADVAVRNSF

SEQ ID NO: 4286 - protein, 70 aa, Canis lupus familiaris
PGARSGRGPLRRARSGGRSGPAAVSSPHGPRRAPRAAAQAPAAAGQQPQQLPGAQGYAGARPSLPRTRAP

SEQ ID NO: 4287-4288 - skipped (2 entries)

SEQ ID NO: 4289 - protein, 14 aa, Canis lupus familiaris
PGPPAGGARPEGGD

SEQ ID NO: 4290 - protein, 19 aa, Canis lupus familiaris
PGPRPRPPPRRGRWTDTSA

SEQ ID NO: 4291 - protein, 37 aa, Canis lupus familiaris
PGTRRRRCPEQFLRRISGEKLLKSSTFPEVVLTLPLL

SEQ ID NO: 4292 - protein, 10 aa, Canis lupus familiaris
PGVLPPGPPN

SEQ ID NO: 4293 - protein, 38 aa, Canis lupus familiaris
PHHPPSPATSSRTCSPTSLGGRWAPSRPRVTTVPISTS

SEQ ID NO: 4294 - protein, 19 aa, Canis lupus familiaris
PHPHLAPSLVPHPYSGPPH

SEQ ID NO: 4295 - protein, 56 aa, Canis lupus familiaris
PHTHTQRLPLPFLLAPKYGLWTQAPGARPQGGILGLEKETHTRDSLPPTCPPERGK

SEQ ID NO: 4296 - protein, 98 aa, Canis lupus familiaris
PLAKAWQRRRCRCRWQRTAAWKMGVGAPGRAGRVRGALRGRRTCGRRRRPRSCRPATASLRRRRRRRRRRSPGWRQTRREGKSWPGGRVPGRPRGPDA

SEQ ID NO: 4297 - protein, 83 aa, Canis lupus familiaris
PLRPPSQLQHRLPELKRSPLGLLRANCPALRSKPREGVPGAGIILNYYQQFTRHPTPAAQPAPCPPEAKQIMSTLRIPPVTRT

SEQ ID NO: 4298 - protein, 36 aa, Canis lupus familiaris
PQCPTPRCAHRPQSSRPRSAPPPRSARRPQGPTPRI

SEQ ID NO: 4299 - skipped

SEQ ID NO: 4300 - protein, 26 aa, Canis lupus familiaris
PRLKGCTAPRCPERPIRDQACCQAAE

SEQ ID NO: 4301 - protein, 19 aa, Canis lupus familiaris
PRPRPAAGAHSGPGRHTPG

SEQ ID NO: 4302 - protein, 44 aa, Canis lupus familiaris
PSLELLGQELWGPWSCAGQGAPSVPGSQQAVLCRAALLATTTLW

SEQ ID NO: 4303 - protein, 80 aa, Canis lupus familiaris
PSPPIPSTRSPTSPSPSTPWGGAAPGKPRATSMRRWRWRSRLGPGGPPASSGTGPCGNAGPGLSREARIQEPGDHSLRTL

SEQ ID NO: 4304 - protein, 16 aa, Canis lupus familiaris
PSRVITSLLSSAHWLL

SEQ ID NO: 4305-4306 - skipped (2 entries)

SEQ ID NO: 4307 - protein, 18 aa, Canis lupus familiaris
PTPQVPLMAPLPLPRRCL

SEQ ID NO: 4308 - protein, 29 aa, Canis lupus familiaris
PTTPLPQRLLQGHVPRPPWGAAGPHQGRE

SEQ ID NO: 4309 - protein, 76 aa, Canis lupus familiaris
QALPSHLPGARRAHRLLRHGAGQPRGSPVQRLCGGGGGGPAWGRGAPLRPRAPGPAEMPVQACPGKPESRSLATTV

SEQ ID NO: 4310 - protein, 9 aa, Canis lupus familiaris
REPGAEGGR

SEQ ID NO: 4311 - protein, 14 aa, Canis lupus familiaris
RSAPRASCSTGSRS

SEQ ID NO: 4312 - protein, 77 aa, Canis lupus familiaris
HYGSHLAGARALAPRYRTSALQLGGSGPRRLGDWPKVTRRGSPPGWGSDADLPHPHAAAGAGAGRGRGALRAVRRPL

SEQ ID NO: 4313 - protein, 57 aa, Canis lupus familiaris
PAPSSESRLPGHRQAPQNSRGPSQRLRVAAPRPPHGRCSFGLRWGFPWRPRLRGGHP

SEQ ID NO: 4314 - protein, 62 aa, Canis lupus familiaris
PGPQVQMEGGGGLRPLHLRPQRGPARLDLGTSPAVLTGRGWERRREEGKKGLGFRAAGHRKA

SEQ ID NO: 4315 - protein, 29 aa, Canis lupus familiaris
PGQQSAGGDRLPWLPPQPVGSQPAPRRGA

SEQ ID NO: 4316 - protein, 32 aa, Canis lupus familiaris
PLRLTSGGCQGACPSLSHFCPAAGRLRPEEAG

SEQ ID NO: 4317 - skipped

SEQ ID NO: 4318 - protein, 13 aa, Canis lupus familiaris
PQRPTPAGPDAPH

SEQ ID NO: 4319 - protein, 79 aa, Canis lupus familiaris
QNQAASKTFFPLPAASHTRRHPGGPAANGRRGGARPRPRRLLGSCTRRPPHGERGAASSRGGAASPHPDRDRRFGIAKD

SEQ ID NO: 4320 - protein, 12 aa, Canis lupus familiaris
RGRRCRWKGAAG

SEQ ID NO: 4321 - protein, 13 aa, Canis lupus familiaris
RSARRPQGPTPRI

SEQ ID NO: 4322 - skipped

SEQ ID NO: 4323 - protein, 44 aa, Canis lupus familiaris
PGAGFWGPTALGTVLWIFLPTLCPSVPRHPLQMLMWPCAKLPTC

SEQ ID NO: 4324 - skipped

SEQ ID NO: 4325 - protein, 38 aa, Canis lupus familiaris
PMAPGRRQSRRPGWVSSRAPSFSLTPTSAPFIPSLPQH

SEQ ID NO: 4326 - protein, 19 aa, Canis lupus familiaris
PPLPGARLPPARTVSRLAG

SEQ ID NO: 4327 - protein, 9 aa, Canis lupus familiaris
PPRGRGVQD

SEQ ID NO: 4328 - protein, 50 aa, Canis lupus familiaris
PRGCAPPPRSAQPGRAHPRDSPAGLRRAGGGVSSARPRARSAACPPGLSE

SEQ ID NO: 4329 - protein, 13 aa, Canis lupus familiaris
PRHSPRVCACVPR

SEQ ID NO: 4330 - protein, 11 aa, Canis lupus familiaris
PRPCCLRGPWP

SEQ ID NO: 4331 - protein, 53 aa, Canis lupus familiaris
PTPLTPCVCVCAALAAGWLSGPPPAPEPSRRRRWLGGRVWVGPAPAWGRLPGS

SEQ ID NO: 4332 - protein, 10 aa, Canis lupus familiaris
QELASGAPLP

SEQ ID NO: 4333 - protein, 12 aa, Canis lupus familiaris
RPAAGAYRISCC

SEQ ID NO: 4334 - skipped

SEQ ID NO: 4335 - protein, 16 aa, Canis lupus familiaris
PAMPPWNGHSRCQSVY

SEQ ID NO: 4336 - protein, 47 aa, Canis lupus familiaris
PGRQGRNRAGDITGAGAPSISGAPQSPQPKSALEAEGQQPPARSLPP

SEQ ID NO: 4337 - protein, 47 aa, Canis lupus familiaris
PPGEPLSPHQDPRRLLLLRVRRHPAQELLRGDGPGHDRYHHVGGRGH

SEQ ID NO: 4338 - protein, 65 aa, Canis lupus familiaris
PPPGCLRDAEGHSGRPGPGTGNAGLAICTLKPGRGARGMELARRWSPPRPTLQKARQARTAWTEG

SEQ ID NO: 4339 - protein, 48 aa, Canis lupus familiaris
PPRRGPGDPGLAALLQVITPARTCSRVMSTFPQTLFFVCLVFCFFFFA

SEQ ID NO: 4340 - protein, 56 aa, Canis lupus familiaris
PRHAALEWPQSLSECLLSPVWYAKAPHSMRKSAWASSPSSSLNLPKLKSVTGTWLW

SEQ ID NO: 4341 - protein, 36 aa, Canis lupus familiaris
PSRRTTVAASRSSATVITACPASPSPRTAAWRWAWT

SEQ ID NO: 4342 - protein, 15 aa, Canis lupus familiaris
PVVQGRGSHPRHPGP

SEQ ID NO: 4343 - protein, 16 aa, Canis lupus familiaris
RPAGDPGTRAWPRCCR

SEQ ID NO: 4344 - protein, 29 aa, Canis lupus familiaris
RPRGVSGMRRVTPGGLGLGLATRASQSAP

SEQ ID NO: 4345 - protein, 88 aa, Canis lupus familiaris
PANTCALGSPEPEGHSGGIQRPALLGGEGGGRGGAGLGGRLRAAPAGGAGRGRRAAPGGAGPRVPLFPQLLPPGRPLQERWPELCPQA

SEQ ID NO: 4346 - protein, 33 aa, Canis lupus familiaris
PARGPAPADPAALAPGPPLPRGRPAKWPPRLSS

SEQ ID NO: 4347 - protein, 28 aa, Canis lupus familiaris
PDSRVCEPVSNHQWHPQYPGGPVVLPDL

SEQ ID NO: 4348 - protein, 46 aa, Canis lupus familiaris
PDTRSRGPSPASPAAPGPRQQRPLAPTRVAPRCPPSSAPGSAPAGF

SEQ ID NO: 4349 - protein, 52 aa, Canis lupus familiaris
PQDPLHAPPGGQQLQSGAAPPSGPPADGAAGSSAGHPPARRAHLRRRGPARP

SEQ ID NO: 4350 - protein, 64 aa, Canis lupus familiaris
PRHALPRPEPGLPRGAGSPPAAPPRPDPGRAALPAQLRPRLRPSGLLSFISSSFPPRHLLGFTS

SEQ ID NO: 4351 - protein, 12 aa, Canis lupus familiaris
PRKHLCFRFPGA

SEQ ID NO: 4352 - protein, 50 aa, Canis lupus familiaris
PRPGTRARRPRRPRARPSAPPRPPRQVAAAPVVLGSSARRTRSPRPGTRV

SEQ ID NO: 4353 - protein, 100 aa, Canis lupus familiaris
PVLPAASASRTCKLCALHPRRPPASGREKGSLPPPHPPLAAGTLGAGVQGESLRGHPGHEEPGSQSVSPAPRPDARAPRPARRGPQLRGCERRPGPLGRS

SEQ ID NO: 4354 - protein, 23 aa, Canis lupus familiaris
PAFILIWFILKTIVMECLVWAGP

SEQ ID NO: 4355 - protein, 48 aa, Canis lupus familiaris
PHPPPLLPPGPSIPAPLLPCRTPTPRGCSWGLRQGARRMRGWRPSRRF

SEQ ID NO: 4356 - protein, 38 aa, Canis lupus familiaris
PTPPPCCPPAPPSPPPSSPAGPRPRGAAPGVCGRGRGG

SEQ ID NO: 4357 - protein, 27 aa, Canis lupus familiaris
PGISCTTSTPRRASTSAGMSTSASPPS

SEQ ID NO: 4358 - protein, 9 aa, Canis lupus familiaris
PLWSIRLRW

SEQ ID NO: 4359 - protein, 32 aa, Canis lupus familiaris
PRTRWQAFGRQLRMEQRVCSWTLSLLLMGFPT

SEQ ID NO: 4360 - protein, 65 aa, Canis lupus familiaris
QVSPVRRQPPGGLQPPQGCLHPRRLPPEDAAADRGVGAGAAPLGPPLSLAEPRHPPGPDSLVRLF

SEQ ID NO: 4361 - protein, 11 aa, Canis lupus familiaris
REHAGRLLAGS

SEQ ID NO: 4362 - protein, 9 aa, Canis lupus familiaris
PRQDPGRPR

SEQ ID NO: 4363 - protein, 9 aa, Canis lupus familiaris
RGRTPGARV

SEQ ID NO: 4364 - protein, 72 aa, Canis lupus familiaris
HAAARAAPTARPARAPPPRPARLPAAGLDVGRRWGRGHAGAQAALPAPGHAGATAVHPRPPPSATPAHRQQE

SEQ ID NO: 4365 - protein, 14 aa, Canis lupus familiaris
HAGRNLQQTPQGIC

SEQ ID NO: 4366 - skipped

SEQ ID NO: 4367 - protein, 80 aa, Canis lupus familiaris
HAPPPADPHLAGTPGPGAPSGLSPGPHMEERWWQRATHEGGDSRGLSAEGGPGPGRQPRQRQAWQAEGRVHEDPGPAAGH

SEQ ID NO: 4368 - protein, 82 aa, Canis lupus familiaris
HAPPPADPHLAGTPGPGAPSGLSPGPHMEGCPKPQGLLRPPDHLDRVYPQPSLTTRGQTRGSWSQDNSHSAPPDPAWQWEGL

SEQ ID NO: 4369 - skipped

SEQ ID NO: 4370 - protein, 31 aa, Canis lupus familiaris
HCGPPPFCFFPPGPEPPGEGETGPGGPPAAA

SEQ ID NO: 4371 - protein, 25 aa, Canis lupus familiaris
HCQHAHTCPEAVQAPLQPFHLSERE

SEQ ID NO: 4372 - protein, 66 aa, Canis lupus familiaris
HDCVHIPGLARSGCQPSHLPWPPPGLPPRSQEPCPGTPSSDTPTHPPQAREGWGSHWSRCHLHPPP

SEQ ID NO: 4373 - protein, 15 aa, Canis lupus familiaris
HFLRRTEAEHTVLLH

SEQ ID NO: 4374 - protein, 12 aa, Canis lupus familiaris
HGGAAPRLPSAV

SEQ ID NO: 4375 - protein, 15 aa, Canis lupus familiaris
HGIPPISAPTQEPVL

SEQ ID NO: 4376 - protein, 24 aa, Canis lupus familiaris
HGLPQPPQLPRGLPGRERRAGHRS

SEQ ID NO: 4377 - protein, 11 aa, Canis lupus familiaris
HGPAGCSRPEL

SEQ ID NO: 4378 - skipped

SEQ ID NO: 4379 - protein, 31 aa, Canis lupus familiaris
HGRGDQGLARGWWERAAAPFPEMLPWPGPRI

SEQ ID NO: 4380 - protein, 20 aa, Canis lupus familiaris
HGRPFSDPNVAPGPLKCQGC

SEQ ID NO: 4381 - protein, 32 aa, Canis lupus familiaris
HGRRGVLGSLQDRGHAHRERVCPRRGARVIRL

SEQ ID NO: 4382 - protein, 48 aa, Canis lupus familiaris
HGTLFFTQRGCQVAAHPPAACGAGPSCTRPQPAGPHPWQPCWLWGASP

SEQ ID NO: 4383 - protein, 45 aa, Canis lupus familiaris
HHHQTGTCGRCHRCFRELCLHHGGQHPSPLQDPPDQLRLHSPRPE

SEQ ID NO: 4384 - protein, 8 aa, Canis lupus familiaris
HHPWEPDL

SEQ ID NO: 4385 - protein, 15 aa, Canis lupus familiaris
HHRARQGAQPHPVLG

SEQ ID NO: 4386 - skipped

SEQ ID NO: 4387 - protein, 8 aa, Canis lupus familiaris
HIIPEATP

SEQ ID NO: 4388 - protein, 10 aa, Canis lupus familiaris
HKAALWLGKS

SEQ ID NO: 4389 - protein, 10 aa, Canis lupus familiaris
HKRGGHPETD

SEQ ID NO: 4390 - protein, 87 aa, Canis lupus familiaris
HLAFLRDGAHHQSQGQASGAQAKPHHPQPEGDRQGHRRGRPRAGGRSPRSPQSPLQEPRHWQEQEVQREHPAHPDPPHEVWHLLAVQ

SEQ ID NO: 4391 - protein, 31 aa, Canis lupus familiaris
HLGCCSCHPPSAPWPQLCLPAQWRPCPPEEQ

SEQ ID NO: 4392 - skipped

SEQ ID NO: 4393 - protein, 18 aa, Canis lupus familiaris
HLPEPPLLRPRQQQPGSG

SEQ ID NO: 4394 - protein, 12 aa, Canis lupus familiaris
HLQPNHVPGTGA

SEQ ID NO: 4395 - protein, 33 aa, Canis lupus familiaris
HLRDAQGRARGGGPRGGAPERSSRYHHRDQHPR

SEQ ID NO: 4396 - protein, 23 aa, Canis lupus familiaris
HLSNISRPYPHHSSHGAYCVEAE

SEQ ID NO: 4397 - protein, 36 aa, Canis lupus familiaris
HLSRGFIQRRHRNPPPDGTGAACGGLDAHQALGSPD

SEQ ID NO: 4398 - protein, 11 aa, Canis lupus familiaris
HNLCRQILWQL

SEQ ID NO: 4399 - protein, 42 aa, Canis lupus familiaris
HPARAGQWPAGLGAPAGGGVTCVLRVQLWGDPHPGNRQADVS

SEQ ID NO: 4400 - protein, 23 aa, Canis lupus familiaris
HPATSEQFRPHHRSTQQRLFPQH

SEQ ID NO: 4401 - protein, 87 aa, Canis lupus familiaris
HPGGRLLPPAIRRALPGHDGVLPAGRHGSGPPPGHLPPAALPRAHEQEGAAGAGGGRLGGRLLGGPGASRPHGRPALLPEAGGPLLL

SEQ ID NO: 4402 - skipped

SEQ ID NO: 4403 - protein, 36 aa, Canis lupus familiaris
HPGLSRAPRGRRLSGAARPEVAPDGPGTLSGRPRRV

SEQ ID NO: 4404 - protein, 16 aa, Canis lupus familiaris
HPHLPGLCREALHEQG

SEQ ID NO: 4405 - protein, 11 aa, Canis lupus familiaris
HPLPPIPWQGP

SEQ ID NO: 4406 - protein, 64 aa, Canis lupus familiaris
HPLPRGPPAPLGKKIHPKSLEPEGGFLSPAGRRALHGSLSAVSPSPRPLPCSHPLLPAPGARSL

SEQ ID NO: 4407 - protein, 33 aa, Canis lupus familiaris
HPLSLPGYPQGRRRRGAGELGAHAFPLCFAPGL

SEQ ID NO: 4408 - protein, 10 aa, Canis lupus familiaris
HPPAAPGLPP

SEQ ID NO: 4409 - protein, 98 aa, Canis lupus familiaris
HPPADASGHPRDHCGLPRPPAGPSGLHSATAPAARTAGEPQSCPRPPLWLVAARCGLVCSSHQDASREEVQQRPVWRSDWLRLLLPAVPPGTTHGGSL

SEQ ID NO: 4410 - protein, 45 aa, Canis lupus familiaris
HPPGAHRPHGGAAAAGTLVPWPDEPEGGREAAPSRRGLPGARQRH

SEQ ID NO: 4411 - skipped

SEQ ID NO: 4412 - protein, 49 aa, Canis lupus familiaris
HPPSAPPGPAVPDPGPGSQETGKDSGAAGRGSGPGRREAEGQGPPLVSP

SEQ ID NO: 4413 - protein, 18 aa, Canis lupus familiaris
HPPTAEEAALGSIAYALG

SEQ ID NO: 4414 - protein, 73 aa, Canis lupus familiaris
HPQEVQAGAQAEWWRGQGGCLIVFGCTARPASPGLPLGLQEAPLPGPQARLACLVVRPPPFAVPLSPPPLAQH

SEQ ID NO: 4415 - skipped

SEQ ID NO: 4416 - protein, 59 aa, Canis lupus familiaris
HPRQPAGFWGRRHSGLEPHNRCFCTEVERGTSELMEGRPQGEATWTPVHRPHHPPPGQV

SEQ ID NO: 4417 - protein, 22 aa, Canis lupus familiaris
HPRQPAGFWGRRHSGLEPHNRL

SEQ ID NO: 4418 - protein, 8 aa, Canis lupus familiaris
HPSNRGGL

SEQ ID NO: 4419 - protein, 15 aa, Canis lupus familiaris
HPTALASHPAPCQPT

SEQ ID NO: 4420 - protein, 11 aa, Canis lupus familiaris
HPTDGDLVYLV

SEQ ID NO: 4421 - protein, 66 aa, Canis lupus familiaris
HPTPVLREHSSEPPVLILCTTEQDTSLGSHITPQARASYDGRWHRKSLPRGYILIRTHWLPSKRVQ

SEQ ID NO: 4422 - protein, 90 aa, Canis lupus familiaris
HPWAPENLVRWVPAALNQAASRRFPHCPRWPRGGQGSPSPPGPRSGALGPGNERCAAGPAVEGALGGREEGPAALGSALEFPERLRSPGQ

SEQ ID NO: 4423 - protein, 78 aa, Canis lupus familiaris
HPWGAQRFFLTSARGLLGQPLGAAPPAPTGPEPHSPLPSCCHSQPPGLHFPPCPGPQLCVSRGHWGPEAGPASRACFC

SEQ ID NO: 4424 - protein, 46 aa, Canis lupus familiaris
HQCILFRRPQSGLPVSRLHLPEAEVLGQERGGRAPGDHHAGAAQTQ

SEQ ID NO: 4425 - protein, 38 aa, Canis lupus familiaris
HQHHHHLPQRGPLHPAQNHPQRIKSHTYESDPGNHISG

SEQ ID NO: 4426 - protein, 65 aa, Canis lupus familiaris
HQLRASDMRRAVAAGRSLAPLPPSHASDLLSRACVQRPGSAADVEEPAAGCGDPGPRGGLSADAR

SEQ ID NO: 4427 - protein, 25 aa, Canis lupus familiaris
HQNLPHEVPRPSQASVHEDEEAARP

SEQ ID NO: 4428 - protein, 66 aa, Canis lupus familiaris
HQPAAPARGNDGAVPAAATATAFSSATAAGATTPATHGRPTGHSERRCGDTVHPDEPEPAILRRDS

SEQ ID NO: 4429-4430 - skipped (2 entries)

SEQ ID NO: 4431 - protein, 17 aa, Canis lupus familiaris
HRHLLLCGQLPVQHRAP

SEQ ID NO: 4432 - protein, 8 aa, Canis lupus familiaris
HRLRPQLK

SEQ ID NO: 4433 - protein, 14 aa, Canis lupus familiaris
HRPGPGAPSLQDGG

SEQ ID NO: 4434 - protein, 35 aa, Canis lupus familiaris
HRPQRLAWGICNRSLLHVRGVSRSHVSFPSERQHP

SEQ ID NO: 4435 - protein, 23 aa, Canis lupus familiaris
HRRRGVPNGLQDSGDAHCPRVLT

SEQ ID NO: 4436 - protein, 10 aa, Canis lupus familiaris
HRTVSPPSRR

SEQ ID NO: 4437 - protein, 10 aa, Canis lupus familiaris
HRVADPRRPN

SEQ ID NO: 4438 - protein, 34 aa, Canis lupus familiaris
HSAAPGGPWAKVQPPLVELSASEVPFGISRSEFM

SEQ ID NO: 4439 - protein, 15 aa, Canis lupus familiaris
HSCSKQYQISVLPQT

SEQ ID NO: 4440 - protein, 15 aa, Canis lupus familiaris
HSCSNQYQIPVLPQT

SEQ ID NO: 4441 - skipped

SEQ ID NO: 4442 - protein, 34 aa, Canis lupus familiaris
HSRKQLSRYCKWRSYDRIGEWPHSKGCHWGPGWV

SEQ ID NO: 4443 - protein, 42 aa, Canis lupus familiaris
HSWPGARCGHRGRCGGSYFSCCPEAGFLGGSSPSRGGGGGGG

SEQ ID NO: 4444 - protein, 12 aa, Canis lupus familiaris
HTCAQEAHCCQD

SEQ ID NO: 4445 - protein, 13 aa, Canis lupus familiaris
HTLCLPGARAWPS

SEQ ID NO: 4446 - skipped

SEQ ID NO: 4447 - protein, 20 aa, Canis lupus familiaris
HTRLGQTHQHPGLQWGLYGA

SEQ ID NO: 4448 - protein, 20 aa, Canis lupus familiaris
HTSGGRTQPHRSSLCSGPDR

SEQ ID NO: 4449 - protein, 18 aa, Canis lupus familiaris
HVHVPEPPRGPGHLRTWK

SEQ ID NO: 4450 - protein, 19 aa, Canis lupus familiaris
LAEQDSERQPQHRAVGAGV

SEQ ID NO: 4451 - protein, 22 aa, Canis lupus familiaris
LAGPFARDPAARGPGGLSRQRR

SEQ ID NO: 4452 - protein, 22 aa, Canis lupus familiaris
LAIPTGVYRPPGIQGLFASEVN

SEQ ID NO: 4453 - protein, 16 aa, Canis lupus familiaris
LARHEEQFGWDPGCLS

SEQ ID NO: 4454 - protein, 17 aa, Canis lupus familiaris
LARHEQEQFGWDPGCLS

SEQ ID NO: 4455 - protein, 14 aa, Canis lupus familiaris
LARIPHWERLAPLL

SEQ ID NO: 4456 - protein, 18 aa, Canis lupus familiaris
LCCQESTGLGSYLYSTYT

SEQ ID NO: 4457 - protein, 68 aa, Canis lupus familiaris
LCLRAPALPPATCPAHVQQLPSQHGPRPSPLRAPSAQCARQLRLCSRPYASGAQPAYALWPPATASLL

SEQ ID NO: 4458 - protein, 31 aa, Canis lupus familiaris
LCPLPGRAPPGRELCPHEGRVSLDGRRWVPI

SEQ ID NO: 4459 - protein, 25 aa, Canis lupus familiaris
LCRSLWDRLWLGPGRSLQGVPEQAI

SEQ ID NO: 4460 - protein, 24 aa, Canis lupus familiaris
LDARVEDPEQLGHWRELPDCPGQR

SEQ ID NO: 4461 - protein, 25 aa, Canis lupus familiaris
LDLHPGGPGGGEPRAGWDLCWRQSV

SEQ ID NO: 4462 - protein, 32 aa, Canis lupus familiaris
LDSRCKAGGGSGLETSSQASGPGGGESSEVPM

SEQ ID NO: 4463 - protein, 22 aa, Canis lupus familiaris
LECSRCEAILTDTVLVTDPPIY

SEQ ID NO: 4464 - protein, 37 aa, Canis lupus familiaris
LEIHRAHRPHPGADDGAEAHRAAGTRGEAAPAREMSL

SEQ ID NO: 4465 - protein, 32 aa, Canis lupus familiaris
LERLFITQVARKAYGLHNFTIHSRTPQQCNEL

SEQ ID NO: 4466 - protein, 15 aa, Canis lupus familiaris
LGFSGRRNGQSTHWQ

SEQ ID NO: 4467 - protein, 20 aa, Canis lupus familiaris
LGGAGGSEEVLKGPAGPLAP

SEQ ID NO: 4468 - protein, 78 aa, Canis lupus familiaris
LGLRPLQVLPAVPSQPAHSIRVLQTRVCVLLLRSQTPGRRRCFQRSKLTPPGRSCPALPGPESVQVKSFQHPQKAHRV

SEQ ID NO: 4469 - protein, 10 aa, Canis lupus familiaris
LGPGVPASFG

SEQ ID NO: 4470 - protein, 25 aa, Canis lupus familiaris
LGPQRLRPQEQWGAVGAPALHAAPH

SEQ ID NO: 4471 - protein, 55 aa, Canis lupus familiaris
LGSRWRPPLLLLLLLLLGELHEEAGGQRPGGLPGEGASAGIQEPDGDRGLLPGND

SEQ ID NO: 4472 - protein, 15 aa, Canis lupus familiaris
LHLRHPDPLGHPGGS

SEQ ID NO: 4473 - protein, 15 aa, Canis lupus familiaris
LHLRHPHPLGHPGGS

SEQ ID NO: 4474-4475 - skipped (2 entries)

SEQ ID NO: 4476 - protein, 29 aa, Canis lupus familiaris
LILTLQHQPQQHQTLTSNGPLFLSRSTRW

SEQ ID NO: 4477 - protein, 11 aa, Canis lupus familiaris
LKQRTPLHLCL

SEQ ID NO: 4478 - protein, 12 aa, Canis lupus familiaris
LLASSFCTARTQ

SEQ ID NO: 4479 - protein, 50 aa, Canis lupus familiaris
LLCCMPGHNLVLFLSVSPSGFCSLPACPSLRVPVSAAEGPAAEVCPVPHQ

SEQ ID NO: 4480 - protein, 14 aa, Canis lupus familiaris
LLCRLTKPDHGVHS

SEQ ID NO: 4481 - protein, 18 aa, Canis lupus familiaris
LLLQKCYQPDRKLGGVSE

SEQ ID NO: 4482 - protein, 11 aa, Canis lupus familiaris
LLPEGRGSVPL

SEQ ID NO: 4483 - protein, 18 aa, Canis lupus familiaris
LLPNASIPRGMSTSPDLQ

SEQ ID NO: 4484 - protein, 21 aa, Canis lupus familiaris
LLSFYIVGRWEALSWCDHKPW

SEQ ID NO: 4485 - protein, 16 aa, Canis lupus familiaris
LLSSCLFPARVPGRPP

SEQ ID NO: 4486 - protein, 21 aa, Canis lupus familiaris
LPAPCHKHCQRKSVLKETATG

SEQ ID NO: 4487 - skipped

SEQ ID NO: 4488 - protein, 45 aa, Canis lupus familiaris
LPAQHAPLTLLCRPQSCRLHPHGPPRVATLAGRAKGPPSAEDPPK

SEQ ID NO: 4489 - protein, 38 aa, Canis lupus familiaris
LPAVLLLVLSNLRLPTSQPLQRPGEAGNQAALPQAGDG

SEQ ID NO: 4490 - protein, 14 aa, Canis lupus familiaris
LPGQPVPDESRRQK

SEQ ID NO: 4491 - protein, 15 aa, Canis lupus familiaris
LPKKSPQEETLYSIL

SEQ ID NO: 4492 - protein, 10 aa, Canis lupus familiaris
LPLAASDWYL

SEQ ID NO: 4493 - protein, 42 aa, Canis lupus familiaris
LPLWSLFRTAGSACCLVYSRTYQFKLTVQQLEKALWQSQPSS

SEQ ID NO: 4494 - protein, 69 aa, Canis lupus familiaris
LPNLCREGATLEEWAGRSGSLRVLGNHQDCARGHAGRLEPEHLVPGEPGIPALYPGPNYDPPASLPTGC

SEQ ID NO: 4495 - protein, 62 aa, Canis lupus familiaris
LPPFRSHSSRPRFKLERWRGLPCRGSLPVRGAWRERRGRTTGRRSPPAPGRTAGCAARRSGP

SEQ ID NO: 4496 - skipped

SEQ ID NO: 4497 - protein, 14 aa, Canis lupus familiaris
LPQPGPGPWHVRRA

SEQ ID NO: 4498 - protein, 9 aa, Canis lupus familiaris
LPQPREGPG

SEQ ID NO: 4499 - protein, 30 aa, Canis lupus familiaris
LPRARGLRGLQAGAGASERLCGRRRRQGPH

SEQ ID NO: 4500 - skipped

SEQ ID NO: 4501 - protein, 11 aa, Canis lupus familiaris
LPRLLVLQAQR

SEQ ID NO: 4502 - protein, 36 aa, Canis lupus familiaris
LPSRHHARSGCGPNSHVPAYIPGAWDWEAHTIWQPN

SEQ ID NO: 4503 - protein, 69 aa, Canis lupus familiaris
LQPRTPGWWFLVTAAAAGKEHSLGALPQVCVQGSQRGKVSPHPEWREHHSQKSLVLAAVVLFKPLLISL

SEQ ID NO: 4504 - protein, 10 aa, Canis lupus familiaris
LRDLPGDQCQ

SEQ ID NO: 4505 - skipped

SEQ ID NO: 4506 - protein, 53 aa, Canis lupus familiaris
LRLHCQHSSLQGHEKEPLLTQGWGALVFGVEQSARRAAPSPCSPSHAAHHVQQ

SEQ ID NO: 4507 - protein, 8 aa, Canis lupus familiaris
LRLPATAR

SEQ ID NO: 4508 - skipped

SEQ ID NO: 4509 - protein, 12 aa, Canis lupus familiaris
LRQRQDLPQRRP

SEQ ID NO: 4510 - protein, 22 aa, Canis lupus familiaris
LRRRGPPSSRGAASACWSPPSL

SEQ ID NO: 4511 - protein, 41 aa, Canis lupus familiaris
LRWRCRPNPHLQYSCALPCEWRVGVLGGVEHLCPSGHKHHV

SEQ ID NO: 4512 - protein, 40 aa, Canis lupus familiaris
LSGLCTFLRGASCKSDCVWGAQRAANRAEQGQCQPGPAKC

SEQ ID NO: 4513 - protein, 30 aa, Canis lupus familiaris
LSLSQPQPTKSQPLPRQPGPPRGPLLGPQE

SEQ ID NO: 4514 - protein, 19 aa, Canis lupus familiaris
LSPADPCPQQEDPEEFSHC

SEQ ID NO: 4515 - skipped

SEQ ID NO: 4516 - protein, 16 aa, Canis lupus familiaris
LSRVGPVQEHQGWFQV

SEQ ID NO: 4517 - protein, 14 aa, Canis lupus familiaris
LSSVQGCFLWKLHL

SEQ ID NO: 4518 - protein, 12 aa, Canis lupus familiaris
LTHGHLGIALCP

SEQ ID NO: 4519 - protein, 51 aa, Canis lupus familiaris
LTPTAPLPGPSEGRHGEDAGRPRGGRGRPCRKVCGLQDISSGQNLPECQPA

SEQ ID NO: 4520 - protein, 34 aa, Canis lupus familiaris
LTRTESSWQDSAPEGQRQGQLRRPAWASRGFATP

SEQ ID NO: 4521 - protein, 15 aa, Canis lupus familiaris
LVLALSSSLSQVNKI

SEQ ID NO: 4522 - protein, 93 aa, Canis lupus familiaris
LVLLTSPSCLHFLPSWAPSLAASLLPVVYFLFCYPAEEVGGLGLDDDLLCSHLPHLRAVFGTERRPGPFLHGQVPGKHLVCMGNTDEPYPHAH

SEQ ID NO: 4523 - protein, 55 aa, Canis lupus familiaris
LWGHQPPPGCPAHADALASALWLHNPAPPWTAAATRCPFQFPFWPRGCHEGHHGV

SEQ ID NO: 4524 - protein, 57 aa, Canis lupus familiaris
LWPPPQPVGQRRLPVAAAHPGDAAGGDQGPARAGAGPGAAHHGPGEHAVRAGGRHRL

SEQ ID NO: 4525 - protein, 56 aa, Canis lupus familiaris
LWPPPQPVGQRRLPVAAHPGDAAGGDQGPARAGAGPGAAHHGPGEHAVRAGGRHRL

SEQ ID NO: 4526 - protein, 9 aa, Canis lupus familiaris
LYATFGVQG

SEQ ID NO: 4527 - protein, 50 aa, Canis lupus familiaris
PAAAALPPHGAGADARARHPHGSEPRGHRPPGLLSTPDVPPIPLSVPGPA

SEQ ID NO: 4528 - protein, 92 aa, Canis lupus familiaris
PAAAHPQVRARSAGLVGRVLLPGAERRPREHLGLCLRQLLSQPDPDPEPRPCPFVRREPQRCGAGPGQAAAGRGQEEDPAMGGVLAAGEAGV

SEQ ID NO: 4529 - protein, 59 aa, Canis lupus familiaris
PAAAHPQVRARSAGLVGRVLLPGREPQRCGAGPGQAAAGRGQEEDPAMGGVLAAGEAGV

SEQ ID NO: 4530 - protein, 55 aa, Canis lupus familiaris
PAAAPPAGARAHRRPPAPGRPPARGIPPARRPPALSPAASRSGARAPTNPREQPV

SEQ ID NO: 4531 - protein, 31 aa, Canis lupus familiaris
PAAAPRGAHLPHHPAQHQLHHWRRADRAQGD

SEQ ID NO: 4532 - protein, 25 aa, Canis lupus familiaris
PAAARRTKHHRPAPGRHREPVPLPP

SEQ ID NO: 4533 - protein, 15 aa, Canis lupus familiaris
PAACHRCYPPAPICH

SEQ ID NO: 4534 - protein, 39 aa, Canis lupus familiaris
PAAFKAPTMQRWRPSSVTMSLRAPANPRGAGGEAAEPRL

SEQ ID NO: 4535 - skipped

SEQ ID NO: 4536 - protein, 99 aa, Canis lupus familiaris
PAAGHPASPSRYTRHPTRRASPTSCTGCRASDGAVGKQAVLVAGAGATQPRQPDAPSVTSLRALARKRKWWRWRLLVLGVPASPNWGTRANGAGGRWTP

SEQ ID NO: 4537 - protein, 40 aa, Canis lupus familiaris
PAAGSRCPTSSASMAPGCASSTSCTRPRTGGSPVGCGGQG

SEQ ID NO: 4538 - protein, 27 aa, Canis lupus familiaris
PAAGVPGTSPAWHWHCGETNQAPGQLL

SEQ ID NO: 4539 - protein, 84 aa, Canis lupus familiaris
PAAHQQAHHLHGRPAALVQRARHAVQGGLCHWPGRWQRLGEDHRGPDDHRGPGRALGGPAVHGLLLQGAHHAAAGAGRPQQLQL

SEQ ID NO: 4540 - protein, 70 aa, Canis lupus familiaris
PAAHVSPQVRARAPRACGNPPRPSCGRAPRGHPRCPGQRPRDDRSGAPGGRHHCGPSHVHSSCSGDRDEG

SEQ ID NO: 4541 - protein, 14 aa, Canis lupus familiaris
PAALAAPAHLSGGH

SEQ ID NO: 4542 - protein, 57 aa, Canis lupus familiaris
PAALMPPPQGLLKGCPRSSQGVRRLRQSVKTVLFPSASGSGPKLPCSSLPKTGCGEG

SEQ ID NO: 4543 - protein, 69 aa, Canis lupus familiaris
PAALPPHRHRQLPRPELACCSLTPGGPTAPPATAAAPVDSGTPLPGVRLATLGPPTGRFRTEGPPCDGG

SEQ ID NO: 4544 - protein, 11 aa, Canis lupus familiaris
PAALWAHHGGL

SEQ ID NO: 4545 - skipped

SEQ ID NO: 4546 - protein, 93 aa, Canis lupus familiaris
PAAPASRPQDRPPPGRAAADPCPGSGHAGQPGGPGARARPRRGHRGLELVVGSTARDFLPELVPGVRAAAAWGGRAGGGGGGGRGQGPGRGGQ

SEQ ID NO: 4547 - protein, 8 aa, Canis lupus familiaris
PAAPGLPP

SEQ ID NO: 4548 - protein, 60 aa, Canis lupus familiaris
PAAPGRRALLPCTARPRTAGPRAAPARGPAERGGPSSGDPQRFLLERGRTAADPLCARRE

SEQ ID NO: 4549 - protein, 58 aa, Canis lupus familiaris
PAAPRGGPCGGPGARRGARALTAPSRTRRSWARSASSRAPSWAARRAVWSSSAAAVST

SEQ ID NO: 4550 - protein, 88 aa, Canis lupus familiaris
PAAPRPQPPLPFTCSRERLRLRAEARPWAGQEGAGVPPGRPRRLAGPAGAPAAREPSRSPRLSLASSRLPRPPAPASLKHSHAGSSAL

SEQ ID NO: 4551 - protein, 68 aa, Canis lupus familiaris
PAAPTECCQRSLGSHTAPSSSKNAQCDRSLEPAEQACPAWDLTEQSPTPAPAAPAAQPPPPEEACSRG

SEQ ID NO: 4552 - protein, 28 aa, Canis lupus familiaris
PAARPRPGAGPSPGPGRCPWSPGTRTGR

SEQ ID NO: 4553 - protein, 35 aa, Canis lupus familiaris
PAARTGVWSWPELLGPQAASRLTVQQGQAWAKRVV

SEQ ID NO: 4554 - skipped

SEQ ID NO: 4555 - protein, 83 aa, Canis lupus familiaris
PAASGYPQPPSFRRGIQGLWTDAKGPIPPRSSPRPKAQMTSFSSGAPARRVCMAWAGPSVQPVGRPAWAAAAPMGAVGAVSRS

SEQ ID NO: 4556 - protein, 56 aa, Canis lupus familiaris
PAASPGCRASASCPGTEAAWTLSPAARACRPLPAMPASPWRGLARSLWTWTLSSSP

SEQ ID NO: 4557 - protein, 11 aa, Canis lupus familiaris
PAASPLAPGLL

SEQ ID NO: 4558 - protein, 15 aa, Canis lupus familiaris
PAASQNRLQTGVLLW

SEQ ID NO: 4559 - protein, 35 aa, Canis lupus familiaris
PAASSQKGSPHRKPKTSTPTLMASGVPRPASCQVG

SEQ ID NO: 4560 - protein, 37 aa, Canis lupus familiaris
PAASTPSSSTPSSSSIPGFPAPCLSSPPAGIPLPTAP

SEQ ID NO: 4561 - protein, 52 aa, Canis lupus familiaris
PAATAATAARPTATTAPAPAATASAPTAAAAPAVTVQYEQQFHSSAHDHGDP

SEQ ID NO: 4562 - protein, 55 aa, Canis lupus familiaris
PAATATPGPQRRAALGRPVAQQVPGARLLGGAAGLCLPAVPGCCGRGRSRARTCP

SEQ ID NO: 4563 - skipped

SEQ ID NO: 4564 - protein, 9 aa, Canis lupus familiaris
PAAVPPEAG

SEQ ID NO: 4565 - protein, 25 aa, Canis lupus familiaris
PAAVQQHPKALADGTRLAWLLLRVL

SEQ ID NO: 4566 - skipped

SEQ ID NO: 4567 - protein, 59 aa, Canis lupus familiaris
PACCRAATPATAPTMPSSTWPAPGVLCQATSSAAPGRSCGPRSHLPKARLLTRSQMASR

SEQ ID NO: 4568 - protein, 39 aa, Canis lupus familiaris
PACCSPTGARRETGFGTRCTSMKRKTPRYPIMWARSNRV

SEQ ID NO: 4569 - protein, 25 aa, Canis lupus familiaris
PACGGRPEGSCSQWIFCRRSFDSFS

SEQ ID NO: 4570 - protein, 88 aa, Canis lupus familiaris
PACPRPPTARSRARRACRAPNSALRGPKPASPLLGVLPPPWPPWLGGGVPGRSALGPPRKGRREARGGCWGGASLRVCGRAFSGEPVA

SEQ ID NO: 4571 - protein, 25 aa, Canis lupus familiaris
PACPSPRGPPAHGASCLQPPQARRR

SEQ ID NO: 4572 - protein, 37 aa, Canis lupus familiaris
PACVCPVLFLQCHQSRGDPPRGDPSVRRSGAIYLQGT

SEQ ID NO: 4573 - protein, 58 aa, Canis lupus familiaris
PADCIELGQVISPHPTLELSPATSNLHPLDPQIWTPGLYPSPMLPSPHPATRVSRLMY

SEQ ID NO: 4574 - protein, 62 aa, Canis lupus familiaris
PADPAVRVQCPEHHAALLLVESLLAHAVPSLLQRKPPVHELHLLHRQPALRRHQLWTLHHHP

SEQ ID NO: 4575 - protein, 60 aa, Canis lupus familiaris
PAEPLWCPPTLGPSLPCSHLRPQASTLGGSRCAGQVDGWTAILGDHQESGQFPGGVSGPV

SEQ ID NO: 4576 - protein, 8 aa, Canis lupus familiaris
PAEPRGPP

SEQ ID NO: 4577 - protein, 42 aa, Canis lupus familiaris
PAESEPPRPWAASSSSTPPSKPTVMKVTSSMQSGWRRVQQAD

SEQ ID NO: 4578 - protein, 34 aa, Canis lupus familiaris
PAESEPPRPWAASSSSTPPSKSGLACAWGTRSQK

SEQ ID NO: 4579 - protein, 30 aa, Canis lupus familiaris
PAETTGPLTAPLQPAQNPRALRSTGQPTEW

SEQ ID NO: 4580 - protein, 52 aa, Canis lupus familiaris
PAETTGPLTAPLQPAQVGSWNWKAEGRIPEPCAPLANPQSGSTETASGDQYL

SEQ ID NO: 4581 - protein, 24 aa, Canis lupus familiaris
PAFALTSPPPSSLPSSPQFQIPTT

SEQ ID NO: 4582 - protein, 14 aa, Canis lupus familiaris
PAFRHADIYGARVG

SEQ ID NO: 4583 - protein, 31 aa, Canis lupus familiaris
PAGAGSRWFSPAAPSTPSSSCPATPCPPTNS

SEQ ID NO: 4584 - protein, 41 aa, Canis lupus familiaris
PAGARAVGLSHAHRGRSLAPALHQAWRSTSHHQDAHRPGLQ

SEQ ID NO: 4585 - protein, 46 aa, Canis lupus familiaris
PAGCWPPSCGSSWRCASGPHSSRAIAASLRSKMRRSVTRPTDVGTR

SEQ ID NO: 4586 - protein, 90 aa, Canis lupus familiaris
PAGGLLRDSRACRERSSHSRGDTGSRTQWAPAPSPASRAHHRHGGHCSGTGRGSAPGLHLHPVLRWGPPLGTQCRALGWNAARHLLPQGP

SEQ ID NO: 4587 - protein, 47 aa, Canis lupus familiaris
PAGNFQISFQVQMPRLLSLIPNGFPRPQILTMCLGPSGQMFLLRAKS

SEQ ID NO: 4588 - protein, 24 aa, Canis lupus familiaris
PAGPGVPAPGQQPSRAGGAPAAPA

SEQ ID NO: 4589-4590 - skipped (2 entries)

SEQ ID NO: 4591 - protein, 33 aa, Canis lupus familiaris
PAGPWSGPGRRLWQPGAPPRAAGQDPGRGPHIQ

SEQ ID NO: 4592 - protein, 30 aa, Canis lupus familiaris
PAGQASPDFLSKLQGQDHASWRGCSPHPGR

SEQ ID NO: 4593 - protein, 24 aa, Canis lupus familiaris
PAGQPHPIWQPRTPGPAAQDPQGV

SEQ ID NO: 4594 - protein, 24 aa, Canis lupus familiaris
PAGQPHTVQQPWMPYPATQDPQGV

SEQ ID NO: 4595 - protein, 13 aa, Canis lupus familiaris
PAGRAQRQPSPPL

SEQ ID NO: 4596 - protein, 9 aa, Canis lupus familiaris
PAGSLSTAE

SEQ ID NO: 4597 - protein, 30 aa, Canis lupus familiaris
PAGSQDSGAASPQPVAPGRICLSCPLTAIN

SEQ ID NO: 4598 - protein, 100 aa, Canis lupus familiaris
PAGSSPAGVPSRSPRPDPVTALRATRTSALGEKRCRLFGEARGSCGEGGRRRLSKPVSSGWAAQDQNWHGCAGKRGTPTAGGLVGGYPPGVVLKGLALPL

SEQ ID NO: 4599 - protein, 28 aa, Canis lupus familiaris
PAGSTGASPLPRTRRMRSQCRRSWSPAR

SEQ ID NO: 4600 - protein, 67 aa, Canis lupus familiaris
PAGTPTRAGPQAAPPARSCCFPGAATGRPGTPLQTPAWWASPLGWPPAPSRARRSPPGPRLGPDSGA

SEQ ID NO: 4601 - skipped

SEQ ID NO: 4602 - protein, 14 aa, Canis lupus familiaris
PAHGDPEHTTSAER

SEQ ID NO: 4603 - protein, 60 aa, Canis lupus familiaris
PAHGDPEHTTSAERWGCSSKPGPETGGPQRPDWQLPATRPGPGTPQRGCTEPQPRPPALL

SEQ ID NO: 4604 - protein, 17 aa, Canis lupus familiaris
PAHHQRGLEAAGILPRL

SEQ ID NO: 4605 - protein, 50 aa, Canis lupus familiaris
PAHLGGAQAPWTRRTGQSPPRGQRRAQNPRSHGQPSAERERASKTPDRNG

SEQ ID NO: 4606 - skipped

SEQ ID NO: 4607 - protein, 41 aa, Canis lupus familiaris
PAHRTFCLRPEKSPSREPAQNPTLVSSLSPEIAPMRENSWR

SEQ ID NO: 4608 - protein, 27 aa, Canis lupus familiaris
PAHSTSTASPWTASCGPPGPPSRPMSP

SEQ ID NO: 4609 - protein, 22 aa, Canis lupus familiaris
PAHTTETRPHQTCPSPSQSWQE

SEQ ID NO: 4610 - protein, 43 aa, Canis lupus familiaris
PAIGLVCWKWLIRGGSGALPASVGTQLLPGTGEAGGRLVGVPG

SEQ ID NO: 4611 - protein, 33 aa, Canis lupus familiaris
PAKASRVPRRTPGTPATKDPGTATWAGTASMPG

SEQ ID NO: 4612 - protein, 32 aa, Canis lupus familiaris
PAKPNTPFIVSMRYFLVKRPSLHRYLSLCIRA

SEQ ID NO: 4613 - protein, 18 aa, Canis lupus familiaris
PAKSFSANQLGTIIQSSC

SEQ ID NO: 4614 - skipped

SEQ ID NO: 4615 - protein, 34 aa, Canis lupus familiaris
PALAKAPRDGRAAPAGLHRPDHLVRVLGAHLAEG

SEQ ID NO: 4616 - protein, 38 aa, Canis lupus familiaris
PALALLSSSWALQTRWPSRMPTRKMISTISLWFPVWSW

SEQ ID NO: 4617 - protein, 19 aa, Canis lupus familiaris
PALAMPSEPTSAIQLCPAL

SEQ ID NO: 4618 - protein, 22 aa, Canis lupus familiaris
PALCPECPPTWTTYLQCHHGNY

SEQ ID NO: 4619 - protein, 81 aa, Canis lupus familiaris
PALGADLAQHLLLLVSVLQGELSGDPRAPRPQGLPRTEGRQGQHGRARRTRAEGSPGRSRHRRPHWLPRTQGCSWLQRREG

SEQ ID NO: 4620 - protein, 100 aa, Canis lupus familiaris
PALGLLGHPAALLPAPPGPRPGGPPAATAQCPAAEGVSSGQLTEERLTPPRGSERGRRRRDASGLPQAAEPGRGRSATCWPRRVARPRRPRPPRELAPHR

SEQ ID NO: 4621 - protein, 9 aa, Canis lupus familiaris
PALGRHACW

SEQ ID NO: 4622 - protein, 29 aa, Canis lupus familiaris
PALHPSPTSHSETQEGPAWSPQVPEQKIL

SEQ ID NO: 4623 - protein, 68 aa, Canis lupus familiaris
PALICSAPLCPWGDTHHPSNLLFHLHATCGTRPLSPAAVLCCCFFGRQHTWGDSLPAPHCPDQGRGSG

SEQ ID NO: 4624 - protein, 57 aa, Canis lupus familiaris
PALLLLCSSSAGPFTSVPTRTPALGPSTSWTQKSPGLAEAAPLPTPCRAGASLGVWR

SEQ ID NO: 4625 - protein, 10 aa, Canis lupus familiaris
PALLRQPLHE

SEQ ID NO: 4626 - skipped

SEQ ID NO: 4627 - protein, 39 aa, Canis lupus familiaris
PALLTHAHTPLTKTEAKAKKKKKEKEKGGGSFKHQKAAH

SEQ ID NO: 4628 - protein, 88 aa, Canis lupus familiaris
PALPACRVLLGQKVLRAPRVPLAQRVRLATQDPLAHRVPLARSSSPCRSRHPGPGGTLTPASCWMTGPARAMWTTRTAWRKSSARSTP

SEQ ID NO: 4629 - skipped

SEQ ID NO: 4630 - protein, 67 aa, Canis lupus familiaris
PALPLLRLCVPPPAGARSPREGARGHPALQVYRLRLQHQKPAEDHLAQPHPHGRKALPLSPLSLCLR

SEQ ID NO: 4631 - protein, 35 aa, Canis lupus familiaris
PALPPSGHAQQHGRPRETPQSPHAGNSPSRTHKSR

SEQ ID NO: 4632 - protein, 33 aa, Canis lupus familiaris
PALPPSGHAQQHGRPRETPQSPHAGNYATRWQF

SEQ ID NO: 4633 - protein, 42 aa, Canis lupus familiaris
PALPWKPRCSFCRRLPPPDILKLLIILLQQASPAPHAQQGLG

SEQ ID NO: 4634 - protein, 16 aa, Canis lupus familiaris
PALQGRSLHVGSTQLR

SEQ ID NO: 4635 - protein, 29 aa, Canis lupus familiaris
PALQVPLGHMVPQDPQVYPDLRAWLESGA

SEQ ID NO: 4636 - protein, 36 aa, Canis lupus familiaris
PALRAASVAALPAHRAQESRWGGFPGGDQQAPTPFP

SEQ ID NO: 4637 - protein, 8 aa, Canis lupus familiaris
PALRLWPV

SEQ ID NO: 4638 - skipped

SEQ ID NO: 4639 - protein, 21 aa, Canis lupus familiaris
PALSCACGTRPSMPRRWTSPC

SEQ ID NO: 4640 - protein, 79 aa, Canis lupus familiaris
PALWLGPGCLRPAQCPLLHDLGGQPQLHHPQRRVLHHHSTGCHDCLLLRGVWCRTAAACSAVQRQEPQPGGSSQGPCGE

SEQ ID NO: 4641 - protein, 26 aa, Canis lupus familiaris
PAMELPPHPPSATRRCRQVAPRHGGL

SEQ ID NO: 4642 - protein, 32 aa, Canis lupus familiaris
PAPADPAAPESDPWSPSDAAAAAFEENIPEIF

SEQ ID NO: 4643 - skipped

SEQ ID NO: 4644 - protein, 63 aa, Canis lupus familiaris
PAPAPLRGFRVSPVSGRAPGPWGPWSAVVFLNPGPTHVLLFGSLSPRLHPTPAGPHALRVPPL

SEQ ID NO: 4645 - protein, 73 aa, Canis lupus familiaris
PAPAPVSGPDAGGGGRPVHRGPPEGGGHRLLGEGGLEVRGHGHRPNLPLGVHHRLPAGDRGPLPAPLAGRHDL

SEQ ID NO: 4646 - protein, 93 aa, Canis lupus familiaris
PAPAQETTRPLAGPWRMGPGGSPSTPSPLAPRAGWTPMMAPGRSPWNRRKNRVCRAQDTNPMAPCPPASSGQRRNSAQWSRSQLRKTRRCTAP

SEQ ID NO: 4647 - protein, 33 aa, Canis lupus familiaris
PAPARSPAARPATGPWEALEMPEGLPSAVPSGT

SEQ ID NO: 4648 - skipped

SEQ ID NO: 4649 - protein, 9 aa, Canis lupus familiaris
PAPCSALRN

SEQ ID NO: 4650-4651 - skipped (2 entries)

SEQ ID NO: 4652 - protein, 47 aa, Canis lupus familiaris
PAPGGPRGPGLAPLPAACDPRAQALEPRAPRGRFSHGGLGGWQESGR

SEQ ID NO: 4653 - protein, 29 aa, Canis lupus familiaris
PAPGLPGVHLPQRGHLSPGGAGPPGVPVP

SEQ ID NO: 4654 - skipped

SEQ ID NO: 4655 - protein, 50 aa, Canis lupus familiaris
PAPGPSGQGVQRGRCGGLPGGVPPGRGPAAAAARAQGAPAAARPGRAGGP

SEQ ID NO: 4656 - protein, 20 aa, Canis lupus familiaris
PAPGPSTCGATSAPKRTGCS

SEQ ID NO: 4657 - protein, 14 aa, Canis lupus familiaris
PAPGQPPGHQRLSQ

SEQ ID NO: 4658 - protein, 14 aa, Canis lupus familiaris
PAPHAKGRNWIRWQ

SEQ ID NO: 4659 - protein, 13 aa, Canis lupus familiaris
PAPHAPPFPARSA

SEQ ID NO: 4660 - protein, 14 aa, Canis lupus familiaris
PAPHHGLPTSAQAG

SEQ ID NO: 4661 - protein, 58 aa, Canis lupus familiaris
PAPIPSSDPQLRSGPRRLHDHQGAAGAGWRPGQQPGRRGPVHTGGPLPCPAPGRQGSR

SEQ ID NO: 4662 - protein, 14 aa, Canis lupus familiaris
PAPKAPQESLDRQE

SEQ ID NO: 4663 - protein, 16 aa, Canis lupus familiaris
PAPLAPFWSGGLHFFL

SEQ ID NO: 4664 - protein, 84 aa, Canis lupus familiaris
PAPLAQQAARPSLQTAPRASSTPCSLRRTRATETHSWLLLLWTQCWPASQGPGAPPALQVPLGHMVPQDPQVYPDLRAWLESGA

SEQ ID NO: 4665 - protein, 11 aa, Canis lupus familiaris
PAPLASPWRWL

SEQ ID NO: 4666 - protein, 47 aa, Canis lupus familiaris
PAPLEFQASMASTVTEVPRVPRAPRVLLENRASQELRASRARRAPTD

SEQ ID NO: 4667 - protein, 57 aa, Canis lupus familiaris
PAPLGKKIHPKSLEPEGGFLSPAGRRALHGSLSAVSPSPRPLPCSHPLLPAPGARSL

SEQ ID NO: 4668 - protein, 17 aa, Canis lupus familiaris
PAPLPVGSLHKGTPEPG

SEQ ID NO: 4669 - protein, 8 aa, Canis lupus familiaris
PAPLPWCT

SEQ ID NO: 4670 - skipped

SEQ ID NO: 4671 - protein, 28 aa, Canis lupus familiaris
PAPLRHHPLTSCSVPGPQAVGSLPSTPS

SEQ ID NO: 4672 - protein, 87 aa, Canis lupus familiaris
PAPLRLLTVTQARPAMVGDCPAPRSSRTQAIPPSSRPRRSGCPSPAPRPRGMPRPPAAPAMGPLSTILWASRKEMEAIIILRAMGPS

SEQ ID NO: 4673 - protein, 78 aa, Canis lupus familiaris
PAPMHIICLEDSVLWPQVWSRSPRNKICTKPRSIPSCSSYMETTSTSLMAMRSKRTSGWAPTPCASAVCTKLLRQSMP

SEQ ID NO: 4674 - protein, 44 aa, Canis lupus familiaris
PAPPAPPAPPPRLLTRRLLSCRTPGPTRTRKRRRPISFPTETPC

SEQ ID NO: 4675 - protein, 39 aa, Canis lupus familiaris
PAPPAPPARLPPQPHPPRGASRRAAARSPRPCPAPSCRS

SEQ ID NO: 4676 - protein, 92 aa, Canis lupus familiaris
PAPPAPPPGPPAPHLGCPTQPPPRASPGMTPLPPAAHQPTGCTCHSPWPCPWASCGCCTWAPQAPARIPCGAPAPRPPKMALPQHRMQGNRG

SEQ ID NO: 4677 - protein, 41 aa, Canis lupus familiaris
PAPPAPPPRLLTRRLLSCRTPGPTRTRKRRRPISFPTETPC

SEQ ID NO: 4678-4679 - skipped (2 entries)

SEQ ID NO: 4680 - protein, 42 aa, Canis lupus familiaris
PAPPIPAPRGAAAPSSPPSSRLHLLWRGLHGYVHQAASPYAS

SEQ ID NO: 4681 - protein, 87 aa, Canis lupus familiaris
PAPPLLVGPPASRRAAVAGRLARARLPARARLPAAPRLLAAPRAPAEPGAAAPHHPPRADGAAGRQQPHVEPARDPGARGRDARSRV

SEQ ID NO: 4682 - protein, 80 aa, Canis lupus familiaris
PAPPPAAGGTAGLPSWAVARTRRAPAAAAASPATQAARPRTTPAAPRLSGAWSRSSGHSCAGRGPSTTRVSKDLKKVVPA

SEQ ID NO: 4683 - protein, 19 aa, Canis lupus familiaris
PAPPPRDVAPSPRACEASF

SEQ ID NO: 4684 - protein, 36 aa, Canis lupus familiaris
PAPPRAPRKGAQSRAPELRACSPAWPRSLLGEPVHS

SEQ ID NO: 4685 - protein, 21 aa, Canis lupus familiaris
PAPPRCLLWGSGRNRRHKPLL

SEQ ID NO: 4686 - protein, 47 aa, Canis lupus familiaris
PAPPRSRPPRSCSSPTPPALPRLRVSGTTCWPGKPRVALDAALGPPA

SEQ ID NO: 4687 - protein, 18 aa, Canis lupus familiaris
PAPPRTRGLPSGPCPGIS

SEQ ID NO: 4688 - skipped

SEQ ID NO: 4689 - protein, 44 aa, Canis lupus familiaris
PAPPTRGWLCQPWCLGCQGQRPARCNTRSRTPSAKLYNLKWTAF

SEQ ID NO: 4690 - protein, 20 aa, Canis lupus familiaris
PAPQALSAATQQATTAPPGA

SEQ ID NO: 4691 - protein, 54 aa, Canis lupus familiaris
PAPQEEPACPWALGTGGQSAEQQSGCRGSSWQQAGAARSQGPESDHLRGLRCLL

SEQ ID NO: 4692 - protein, 56 aa, Canis lupus familiaris
PAPQGDLEPLVLQVPQEELLKVTFLTQVHPEMWVLLAPMVREERPGPQAPPGALTF

SEQ ID NO: 4693 - protein, 88 aa, Canis lupus familiaris
PAPQPGGPPPPPPAARRRTAPLVAPLLRPADSLTPQQPGGNLRPGGRAGAPLVRSPPALPGSPEAAGARRTARPRPARLRLGDPGLAR

SEQ ID NO: 4694 - protein, 11 aa, Canis lupus familiaris
PAPQQDFVVCL

SEQ ID NO: 4695 - protein, 10 aa, Canis lupus familiaris
PAPRATPASR

SEQ ID NO: 4696 - protein, 23 aa, Canis lupus familiaris
PAPRPRWAPPSPRPPPASPGALR

SEQ ID NO: 4697 - protein, 11 aa, Canis lupus familiaris
PAPRRERLSPT

SEQ ID NO: 4698 - skipped

SEQ ID NO: 4699 - protein, 23 aa, Canis lupus familiaris
PAPSPASSVGPGASSCRRPLSSA

SEQ ID NO: 4700 - protein, 71 aa, Canis lupus familiaris
PAPSPPPRPGLVRGGGGHGWDRGLGPVPCPEQPHQTASLPGGRWAVALPPFCGDPWHHQACHREVPLPSQE

SEQ ID NO: 4701 - protein, 14 aa, Canis lupus familiaris
PAPSRQGRLPSHPA

SEQ ID NO: 4702 - protein, 40 aa, Canis lupus familiaris
PAPSSSPEACSASTAQQDPTSASSEDDAQADVSGLRNRAV

SEQ ID NO: 4703 - protein, 21 aa, Canis lupus familiaris
PAPTGNGALPCGQSEQLKQLL

SEQ ID NO: 4704 - protein, 28 aa, Canis lupus familiaris
PAPTRCGPRTPPPSFRPTRPSCPGSRTW

SEQ ID NO: 4705 - protein, 63 aa, Canis lupus familiaris
PAPTRPACRLRRAAPVTVPPLRLLVPPQDRSPAARPAPDHRPGCQSSRRARASRSTASSWARL

SEQ ID NO: 4706 - protein, 8 aa, Canis lupus familiaris
PAPTSPAT

SEQ ID NO: 4707 - protein, 47 aa, Canis lupus familiaris
PAPVPQPEQQRHRQRHLPEHARHQVSYLVSAFFQTGEPPPQRGDVPL

SEQ ID NO: 4708 - protein, 28 aa, Canis lupus familiaris
PAPVSILGEPDLCCGHGWHAALRCIFQN

SEQ ID NO: 4709 - protein, 17 aa, Canis lupus familiaris
PAPWAASWSKSPAAVAA

SEQ ID NO: 4710 - skipped

SEQ ID NO: 4711 - protein, 22 aa, Canis lupus familiaris
PAQGFQGCGSSLTCHEECGPAH

SEQ ID NO: 4712 - skipped

SEQ ID NO: 4713 - protein, 54 aa, Canis lupus familiaris
PAQGSSLQQQPWGPSAHSGWAALQVPLPLWRPHAPRLHFRRKRPQEVVCHHSQL

SEQ ID NO: 4714 - skipped

SEQ ID NO: 4715 - protein, 96 aa, Canis lupus familiaris
PAQRTRPPQRLWTGGIPARWKSFGVSSRPISVAPGGRTDPSVTRQAQQRPFRRRRARTAPACQRRRFLQACQRRRSSQALLRRVPAACQRRGLPPA

SEQ ID NO: 4716 - protein, 44 aa, Canis lupus familiaris
PARAAHPAAPAPARPAATGAPGRAHTAGRRPQPTAHDLPELVRL

SEQ ID NO: 4717 - skipped

SEQ ID NO: 4718 - protein, 44 aa, Canis lupus familiaris
PARAGGRQGVRSSREERQQESGRGKARERALTFGGAVLGAADEK

SEQ ID NO: 4719 - protein, 34 aa, Canis lupus familiaris
PARAPGQALPQETQQPRSRRRRLRSRPRVVRRVA

SEQ ID NO: 4720 - protein, 11 aa, Canis lupus familiaris
PARARPRTAWA

SEQ ID NO: 4721 - protein, 86 aa, Canis lupus familiaris
PARCPLRPRPVVPQAPARRPLRTLLPGPACQDPARRPQDPPARTCPPGTRPPGPGPPSPRTCPAAACSQHAPHPTWNPTWGSLVTI

SEQ ID NO: 4722 - protein, 13 aa, Canis lupus familiaris
PAREGRAATVAES

SEQ ID NO: 4723 - protein, 12 aa, Canis lupus familiaris
PARGMAPTAEKS

SEQ ID NO: 4724 - protein, 49 aa, Canis lupus familiaris
PARGRPARVWPPALAVRRPPGPGHGTGVTQLSPPRRAPRPAPGLLPRPA

SEQ ID NO: 4725 - protein, 49 aa, Canis lupus familiaris
PARGTGQSAPCCCPHHFHWQPHNPRRLVYLCGRVPEAASGHSARPRLAR

SEQ ID NO: 4726 - protein, 35 aa, Canis lupus familiaris
PARILCTVHVSIPTRSSPETPAPAASTPARLHPPV

SEQ ID NO: 4727 - protein, 37 aa, Canis lupus familiaris
PARLETPSSLLVPSLLGVTRLQPTIHSLALQMNLLSS

SEQ ID NO: 4728 - protein, 33 aa, Canis lupus familiaris
PARLPPQPHPPRGASRRAAARSPRPCPAPSCRS

SEQ ID NO: 4729 - skipped

SEQ ID NO: 4730 - protein, 31 aa, Canis lupus familiaris
PARPPLGGAEQDGGSHRDRLLQQPGSVPAPG

SEQ ID NO: 4731 - protein, 11 aa, Canis lupus familiaris
PARPRGVQEGA

SEQ ID NO: 4732 - protein, 51 aa, Canis lupus familiaris
PARPSRASCPACQSWSSPRPPPSSPLRSPSRRPPQLCSHPKAASRRRPSRS

SEQ ID NO: 4733 - protein, 93 aa, Canis lupus familiaris
PARRARPPTASFSAPHSGPPWPEPTVLLTKQASPHPLQKNQASTSPATRKDQTLTWDLPGQLLAPTMPIGTREKDCLKATRQIYLGALEPLKT

SEQ ID NO: 4734 - protein, 8 aa, Canis lupus familiaris
PARRGRSP

SEQ ID NO: 4735 - protein, 9 aa, Canis lupus familiaris
PARRPRTGT

SEQ ID NO: 4736 - protein, 39 aa, Canis lupus familiaris
PARRQGLQPQRLYTLRLVFFLHSQLFELLQQEAFQTHKD

SEQ ID NO: 4737 - protein, 14 aa, Canis lupus familiaris
PARRQGLRGSRAAD

SEQ ID NO: 4738 - protein, 25 aa, Canis lupus familiaris
PARRRPPPVHSGSITPTIRAPITRT

SEQ ID NO: 4739 - protein, 16 aa, Canis lupus familiaris
PARSHGPIARTCMRTL

SEQ ID NO: 4740 - protein, 24 aa, Canis lupus familiaris
PARTQQLRGASARLQHPGQCQLLR

SEQ ID NO: 4741 - protein, 75 aa, Canis lupus familiaris
PASAAGETAMPASTPGAMCPQNQGAMPPQGSRALPHQDSRALPHQGSRALPAQGSRAMSLNSDSSTSSAEDQAEV

SEQ ID NO: 4742 - protein, 20 aa, Canis lupus familiaris
PASARQSFPAAAGLPLQDGW

SEQ ID NO: 4743 - skipped

SEQ ID NO: 4744 - protein, 13 aa, Canis lupus familiaris
PASATPTPTLPSS

SEQ ID NO: 4745 - protein, 36 aa, Canis lupus familiaris
PASATSSSSTEARTRSSGRAGTGPASPTAASSLALR

SEQ ID NO: 4746-4747 - skipped (2 entries)

SEQ ID NO: 4748 - protein, 13 aa, Canis lupus familiaris
PASGVAGRWLSGP

SEQ ID NO: 4749 - protein, 35 aa, Canis lupus familiaris
PASGVGRPAPQQRSIVPQLPSWWPHPARRAAWSWG

SEQ ID NO: 4750 - protein, 12 aa, Canis lupus familiaris
PASLHSRVGLRS

SEQ ID NO: 4751 - protein, 26 aa, Canis lupus familiaris
PASLLPPGPGGHRLQQCQDETHPCPD

SEQ ID NO: 4752 - skipped

SEQ ID NO: 4753 - protein, 13 aa, Canis lupus familiaris
PASPDALPAPRGS

SEQ ID NO: 4754 - protein, 69 aa, Canis lupus familiaris
PASPLSPPGRTRVRPGPRRQRAAPPLCGGEPRPARPCRTGTPSSPWRGPGWTLPPRATGGPRPLAARNT

SEQ ID NO: 4755 - protein, 43 aa, Canis lupus familiaris
PASPPFPGPKGASSRGHRLLPGLGRGCWCPGSRRPRPWARWEP

SEQ ID NO: 4756 - protein, 23 aa, Canis lupus familiaris
PASPREPLLGAASSACHGHHSDA

SEQ ID NO: 4757 - protein, 53 aa, Canis lupus familiaris
PASPVSALPARLKQLCSQPSRVGEVWLVLGTNELGRCRDEAEREARWLFPGTR

SEQ ID NO: 4758 - protein, 65 aa, Canis lupus familiaris
PASQREHGRLWKLDGKPGFDQLAHPPAPSSSPEACSASTAQQDPTSASSEDDAQADVSGLRNRAV

SEQ ID NO: 4759 - protein, 32 aa, Canis lupus familiaris
PASRSWCTCRSSACSTRLPGCPSRCRSSCGTA

SEQ ID NO: 4760 - skipped

SEQ ID NO: 4761 - protein, 17 aa, Canis lupus familiaris
PASSILCREPSGALCSP

SEQ ID NO: 4762 - protein, 11 aa, Canis lupus familiaris
PASSTPTSTPC

SEQ ID NO: 4763 - protein, 41 aa, Canis lupus familiaris
PASSWFGVKKRTSLKSAWCGCTWSEPSTCSPKIPMACATLM

SEQ ID NO: 4764 - protein, 34 aa, Canis lupus familiaris
PASTLTRPQAGAASRSPVPLGLCPPDAELSLRPG

SEQ ID NO: 4765 - protein, 10 aa, Canis lupus familiaris
PASTTPTPTG

SEQ ID NO: 4766 - protein, 37 aa, Canis lupus familiaris
PASTVARESSISHSTTREETFACGVPGHPAETKDTQM

SEQ ID NO: 4767 - protein, 12 aa, Canis lupus familiaris
PATAPARGRGQI

SEQ ID NO: 4768 - skipped

SEQ ID NO: 4769 - protein, 52 aa, Canis lupus familiaris
PATASPRIQKMGTSVALGCLGRQGKAQFPENQSQISQRLWWVQGLRKLVWVL

SEQ ID NO: 4770 - protein, 69 aa, Canis lupus familiaris
PATEGGGAGPRGPGPLGWEGGAGGPRLRAVRTRVTLRAAGPGRATGGAREAPPSPARLPAPLPAPLRPG

SEQ ID NO: 4771 - protein, 43 aa, Canis lupus familiaris
PATERSPTSRRPAGTPSTGSAGSAEGSCRRSAGACCRSRSPCW

SEQ ID NO: 4772 - protein, 12 aa, Canis lupus familiaris
PATGEDQRHRGL

SEQ ID NO: 4773 - protein, 18 aa, Canis lupus familiaris
PATGPPRGTCRPARPACP

SEQ ID NO: 4774 - skipped

SEQ ID NO: 4775 - protein, 37 aa, Canis lupus familiaris
PATPHQKGDHLSSWLSRGVAASLETKAEDYLKRYRYS

SEQ ID NO: 4776 - protein, 54 aa, Canis lupus familiaris
PATPLSAMCSAATLTPCSTRASCTRGCLWSTTRTPASCTAGPPMSTLLRSFGTL

SEQ ID NO: 4777 - protein, 29 aa, Canis lupus familiaris
PATPSTRRPNQACAMCPSCVHSTQLPRTG

SEQ ID NO: 4778 - protein, 38 aa, Canis lupus familiaris
PATQAGGHPQHGLSGPRGRRAGRRGGGHGLPAPGAPAQ

SEQ ID NO: 4779 - protein, 30 aa, Canis lupus familiaris
PATQTWAAWDCGTHTRRTPRASWMSTCSGS

SEQ ID NO: 4780 - protein, 33 aa, Canis lupus familiaris
PATRQEQPPQPTLRAQPPPGQLPAGLPAPRHGL

SEQ ID NO: 4781 - protein, 35 aa, Canis lupus familiaris
PATSALFLPCPCPSPPSWHRRTNAALRPDQQQPPC

SEQ ID NO: 4782 - protein, 14 aa, Canis lupus familiaris
PATSTSSFQSRPQA

SEQ ID NO: 4783 - protein, 27 aa, Canis lupus familiaris
PATTPRWEARATPEARPPSPAPSHGTA

SEQ ID NO: 4784 - protein, 56 aa, Canis lupus familiaris
PATTSMGTPAPVRTSTNALHTRASVALVPATTPWGTTPVSALQSTCKSTVATTAWT

SEQ ID NO: 4785 - protein, 22 aa, Canis lupus familiaris
PAVFGDHHRQILLLEGCPGPTP

SEQ ID NO: 4786 - protein, 9 aa, Canis lupus familiaris
PAVGFGLGI

SEQ ID NO: 4787 - protein, 25 aa, Canis lupus familiaris
PAVGREGWRPAWGGPRSAWEGRKLA

SEQ ID NO: 4788 - protein, 56 aa, Canis lupus familiaris
PAVLARTCCICSRFPWISSTRRMRSMNFLTLENPAVPRVCHPPPSRHPWWWSGPLA

SEQ ID NO: 4789 - protein, 8 aa, Canis lupus familiaris
PAVLGHST

SEQ ID NO: 4790 - protein, 23 aa, Canis lupus familiaris
PAVPSVPRAASAKEARTSAAAVP

SEQ ID NO: 4791 - skipped

SEQ ID NO: 4792 - protein, 81 aa, Canis lupus familiaris
PAVTRASAPRATGAVGAWRGRPPPTARSSATTRGPRPSSTSRAAGRPPCWRGPGSPTHTSPPWRAQLPGAKKRINRKGTLS

SEQ ID NO: 4793 - protein, 49 aa, Canis lupus familiaris
PAWAGTPDGVRLGAGWAERPVQHGPGLPHRPGAGQPVPSAPCLLDCQLR

SEQ ID NO: 4794 - protein, 19 aa, Canis lupus familiaris
PAWDRFQLPACPGRGLPLP

SEQ ID NO: 4795 - protein, 47 aa, Canis lupus familiaris
PAWPAAAQQDRGRRPPALWEPRVPCEPHACGPQVPSGLGLWRGVHGL

SEQ ID NO: 4796 - protein, 8 aa, Canis lupus familiaris
PAWSSLWL

SEQ ID NO: 4797 - protein, 45 aa, Canis lupus familiaris
PCAAHISLLPPFPSQLGPQPCCLSTSSGIFSILLSSGRSGWTWPG

SEQ ID NO: 4798 - protein, 20 aa, Canis lupus familiaris
PCAAPSATLRAATSWCSITT

SEQ ID NO: 4799 - protein, 22 aa, Canis lupus familiaris
PCAGQWGSPQHRRPAQPPPGGP

SEQ ID NO: 4800 - protein, 10 aa, Canis lupus familiaris
PCAGVPCGGC

SEQ ID NO: 4801 - protein, 26 aa, Canis lupus familiaris
PCAHPGPRGAPRRGGAARGRAGAGSR

SEQ ID NO: 4802 - protein, 84 aa, Canis lupus familiaris
PCAPHPSPQRGRCPQLPTFLPPPPPLARPPRIRPPGCQPLRQLTSSSSFRLARENTSPPRPLRPSTCSLSPLRPPHRLLGPSRW

SEQ ID NO: 4803 - skipped

SEQ ID NO: 4804 - protein, 13 aa, Canis lupus familiaris
PCARSLFLSLPSQ

SEQ ID NO: 4805 - protein, 26 aa, Canis lupus familiaris
PCASAEKPLNAFCHLHPQYPPPHLPR

SEQ ID NO: 4806 - protein, 47 aa, Canis lupus familiaris
PCCAPASAPSTRPAGRPGTTSTARSPRRPLPLAWAVAAPRGRPPWPG

SEQ ID NO: 4807 - protein, 82 aa, Canis lupus familiaris
PCCVSPKALSSRRWWHTTSIFARWSGYIICQGWRGCLWTCRPWWTSGITSTRSWPCASTQTLTARVPSSRTSMAFRCSPGAI

SEQ ID NO: 4808 - protein, 15 aa, Canis lupus familiaris
PCFILPTPLTCPTTS

SEQ ID NO: 4809 - protein, 30 aa, Canis lupus familiaris
PCGGGSRTETQEEGCHQAAGLSPVVPGCLR

SEQ ID NO: 4810 - protein, 42 aa, Canis lupus familiaris
PCGLLEQRTRKAEQAVQSHFEHVGQPDGRSIRVFQHKPSKFL

SEQ ID NO: 4811 - protein, 9 aa, Canis lupus familiaris
PCGRGELIR

SEQ ID NO: 4812 - protein, 28 aa, Canis lupus familiaris
PCHLCPLPPLSLPLSPFLAPKDQRCTAT

SEQ ID NO: 4813 - protein, 39 aa, Canis lupus familiaris
PCHLYIPTSKLFPGHKEAARFTAVTVIVKAIAQPNLPKT

SEQ ID NO: 4814 - protein, 18 aa, Canis lupus familiaris
PCHPHRCLQTTRNSGTFC

SEQ ID NO: 4815 - protein, 75 aa, Canis lupus familiaris
PCHRRGPAASGTLGLRPSTLTCPAAGRTWSLRRKPSQWCPCGGNGLVGETAGATGLVDPRGWSATWPGMRAPQPL

SEQ ID NO: 4816-4817 - skipped (2 entries)

SEQ ID NO: 4818 - protein, 79 aa, Canis lupus familiaris
PCHRRGPAASGTLGLRPSTLTCPAAGRTWSLRRKPSQWCPCGGNGLVGETAVSTVGATGLVDPRGWSATWPGMRAPQPL

SEQ ID NO: 4819-4820 - skipped (2 entries)

SEQ ID NO: 4821 - protein, 15 aa, Canis lupus familiaris
PCLAHHRDITWTPTA

SEQ ID NO: 4822 - protein, 26 aa, Canis lupus familiaris
PCLCMPSSISSMSPIQRRSSEGRSLG

SEQ ID NO: 4823 - protein, 42 aa, Canis lupus familiaris
PCLGVCCCFACSPQVSITSCPVTWMDLLSKTSPSESRDPSKP

SEQ ID NO: 4824 - protein, 9 aa, Canis lupus familiaris
PCLIAWLTH

SEQ ID NO: 4825 - protein, 9 aa, Canis lupus familiaris
PCLMTSSKT

SEQ ID NO: 4826 - protein, 22 aa, Canis lupus familiaris
PCLQHSLQGTLWCSLLSLAHCW

SEQ ID NO: 4827 - skipped

SEQ ID NO: 4828 - protein, 13 aa, Canis lupus familiaris
PCLSKGAWQIMET

SEQ ID NO: 4829 - protein, 17 aa, Canis lupus familiaris
PCLVTQGTNWRKRRKGA

SEQ ID NO: 4830 - skipped

SEQ ID NO: 4831 - protein, 71 aa, Canis lupus familiaris
PCPCGWPDGCALHFPQPAWWHGLWNCHRKPALLSTVSPLHCHPPVGVFDFSYPAIPRHLHSVQLAQPPCPC

SEQ ID NO: 4832 - protein, 14 aa, Canis lupus familiaris
PCPGRRPPATAHLL

SEQ ID NO: 4833 - protein, 32 aa, Canis lupus familiaris
PCPLPPCPPPGAPRARIPSSPAGLQRAHLAPG

SEQ ID NO: 4834 - protein, 35 aa, Canis lupus familiaris
PCPMWSSTRWCGPDVCQRPEPAEPCPPTWTCTQRV

SEQ ID NO: 4835 - protein, 14 aa, Canis lupus familiaris
PCPNSPLGTLGPVI

SEQ ID NO: 4836 - protein, 62 aa, Canis lupus familiaris
PCPPPQPHQSLGDPRRTCVVTASPRAENPLSLRMHPVSSPCTPLLPLRMVLRANPSLDPKAL

SEQ ID NO: 4837 - protein, 29 aa, Canis lupus familiaris
PCPPPTARSPRRAGRTAAAAATAATTAAC

SEQ ID NO: 4838 - protein, 27 aa, Canis lupus familiaris
PCPPSEATNRQLIFLGFKRRHCRTQKK

SEQ ID NO: 4839 - protein, 26 aa, Canis lupus familiaris
PCPPSSLASVCSTSRTKIKVNSSLLS

SEQ ID NO: 4840 - protein, 22 aa, Canis lupus familiaris
PCPQDHPSRGRDADRGPATAAV

SEQ ID NO: 4841 - protein, 13 aa, Canis lupus familiaris
PCPSPCSACTVLL

SEQ ID NO: 4842 - protein, 37 aa, Canis lupus familiaris
PCPVPCQSCITRDTWTPPQRGPASPARSSTRLPWLQP

SEQ ID NO: 4843 - protein, 55 aa, Canis lupus familiaris
PCPVPCQSCITRDTWTPPQRGPASPARSSTRVSGCQNHGSSQCLVDAHGLPWLQP

SEQ ID NO: 4844 - protein, 74 aa, Canis lupus familiaris
PCPVPCQSCITRDTWTPPQRGPASPARSSTRYSPCAALPPPPPTTGTAGWTRGSSLATGAPAPLHWGRAAGSSG

SEQ ID NO: 4845 - protein, 12 aa, Canis lupus familiaris
PCPWGPRTHHQC

SEQ ID NO: 4846 - protein, 55 aa, Canis lupus familiaris
PCPWTPGTSLASSPRRSPSPWPRSWHWCYPTIPSPPCPPACPRPSSPASLTFCRT

SEQ ID NO: 4847 - protein, 59 aa, Canis lupus familiaris
PCQGGRERVPPRQDPHWQLLLPQQGGPRHEQGPPGLPLRPASPGPGGALLGLADGGPHG

SEQ ID NO: 4848 - skipped

SEQ ID NO: 4849 - protein, 19 aa, Canis lupus familiaris
PCQPPASWPGRPSPAAMSR

SEQ ID NO: 4850 - protein, 24 aa, Canis lupus familiaris
PCQPRCPSRSPWFLTTAPPCTSSG

SEQ ID NO: 4851 - protein, 68 aa, Canis lupus familiaris
PCQRAPPTQSPMHLQARYRGTLHPQPLNPALPTARLLSRSRHPHLDCPAPPSAWKQVCVPSWWTGVLG

SEQ ID NO: 4852 - protein, 28 aa, Canis lupus familiaris
PCQRRHLYAGPLPLLPELHSELYPGGRD

SEQ ID NO: 4853 - protein, 38 aa, Canis lupus familiaris
PCQSPRQYLWGPDHGLDGERGHHCSQPAVPCPPYAEGH

SEQ ID NO: 4854 - protein, 18 aa, Canis lupus familiaris
PCQTPRCSGRGLSSRNFC

SEQ ID NO: 4855 - protein, 89 aa, Canis lupus familiaris
PCRAAPALGQRAPLRPQPGPAGELPAPRRRWASLSALALGRPHPSAASICPLASPHQARQWKLCAGGWEMYILQTAAARMSSLHVTSLL

SEQ ID NO: 4856 - protein, 94 aa, Canis lupus familiaris
PCRCRRRRRRPPGRRVRALPGPHRRRLQPPARAAGRARAARRRRPQSARLAVRRGGRAQRPELRLWAGQRHRERFRRGAGHAGARRAEGGQRPG

SEQ ID NO: 4857 - protein, 27 aa, Canis lupus familiaris
PCRGHLPGEIQERVLPLLSKVSIQHKK

SEQ ID NO: 4858 - protein, 8 aa, Canis lupus familiaris
PCRHLWSR

SEQ ID NO: 4859 - protein, 34 aa, Canis lupus familiaris
PCRNHVYRSGLFCGLPSTLAPTTTSIPPPSHPNP

SEQ ID NO: 4860 - protein, 19 aa, Canis lupus familiaris
PCRPGWGGRPPGAPSKPHQ

SEQ ID NO: 4861 - protein, 39 aa, Canis lupus familiaris
PCRPRCAGPVSRTPCCTAPGGVPSRPRRTQPSPAKATSS

SEQ ID NO: 4862 - protein, 24 aa, Canis lupus familiaris
PCRQTEAPCLGGGQNNFFRTEIHA

SEQ ID NO: 4863 - protein, 31 aa, Canis lupus familiaris
PCRQYRCTFPPWSPGAGAVTDSSSCSSWRAR

SEQ ID NO: 4864 - skipped

SEQ ID NO: 4865 - protein, 26 aa, Canis lupus familiaris
PCRSLKSPGSKPEYMSGTLAFSSQAE

SEQ ID NO: 4866 - protein, 19 aa, Canis lupus familiaris
PCRTRQRKAASAQSSRSGG

SEQ ID NO: 4867 - protein, 8 aa, Canis lupus familiaris
PCSCQSPP

SEQ ID NO: 4868 - protein, 92 aa, Canis lupus familiaris
PCSCRRLRAYASSWSMWQSPWSHHLPLSCLSRRHLWASSGSPGPAATSSLAASAMQPSSLSMASQCWSMVAPTPSRAFGSWCGTWTGWMLCW

SEQ ID NO: 4869 - protein, 53 aa, Canis lupus familiaris
PCSCRRSGAGPTLCCCARSAGTAAAARTPAKSLRQQAGLSAADRRKSKASHSS

SEQ ID NO: 4870 - protein, 41 aa, Canis lupus familiaris
PCSDSTEASQSGCHNDSQGKRSLFHERGIEIYRQWVIFIRL

SEQ ID NO: 4871 - protein, 11 aa, Canis lupus familiaris
PCSNWPAQTPP

SEQ ID NO: 4872 - skipped

SEQ ID NO: 4873 - protein, 16 aa, Canis lupus familiaris
PCSRGKAPGDGTATHK

SEQ ID NO: 4874 - protein, 18 aa, Canis lupus familiaris
PCSRRSPGPWPCTPSRGL

SEQ ID NO: 4875 - protein, 16 aa, Canis lupus familiaris
PCSYPPEQRPKPPSEW

SEQ ID NO: 4876 - protein, 62 aa, Canis lupus familiaris
PCTGFHPGRAGSMLWPWLACGSQMHLPELMSPAVLQALLPLRPLGLSLALSTRMSPCLSTQP

SEQ ID NO: 4877 - protein, 19 aa, Canis lupus familiaris
PCTLSDPVRISAWMTVTKT

SEQ ID NO: 4878 - skipped

SEQ ID NO: 4879 - protein, 12 aa, Canis lupus familiaris
PCTSGKPDHPGL

SEQ ID NO: 4880 - protein, 83 aa, Canis lupus familiaris
PCTTWGPIHGGHGGPRWGEWPCPGAAGGPGPWGAAVSVQQTPGLERGPRMAGEAQTCLRGRQHQADAIAALPGLCESRRELKD

SEQ ID NO: 4881 - protein, 11 aa, Canis lupus familiaris
PCWCSPAPPRS

SEQ ID NO: 4882 - protein, 16 aa, Canis lupus familiaris
PCWTSHLMQMTRPWLN

SEQ ID NO: 4883 - protein, 13 aa, Canis lupus familiaris
PCWVVAAAGWGGL

SEQ ID NO: 4884 - protein, 59 aa, Canis lupus familiaris
PDAAAPDVQPPGAASHSGQGGKQEERHGCWTAGATKASQRHWPGAPPASATPTPTLPSS

SEQ ID NO: 4885 - protein, 45 aa, Canis lupus familiaris
PDAARPAGPEGAGRRDSGPELHGRGQPGAPAELVQGRGGPAGWGA

SEQ ID NO: 4886 - protein, 10 aa, Canis lupus familiaris
PDASFPASIS

SEQ ID NO: 4887 - protein, 38 aa, Canis lupus familiaris
PDCAATPTSPLLLRLGAAPRLLASAAPGPRLRHCALQL

SEQ ID NO: 4888 - protein, 66 aa, Canis lupus familiaris
PDCGSGHTVVCGLHSGWGVPSFGGPSPPGVSRREAALHSPVQKGLPLGHGKCQSKPRRRGYPAAMV

SEQ ID NO: 4889 - protein, 45 aa, Canis lupus familiaris
PDDGRSLSPSAHPDAEFGAQVGKRGCGHEAPPAFRALAAVSRRKE

SEQ ID NO: 4890 - protein, 18 aa, Canis lupus familiaris
PDFKSYLMFIHHSRGISW

SEQ ID NO: 4891 - protein, 31 aa, Canis lupus familiaris
PDGAAGVRGEAGLPPRGQHAERARAGRGGFL

SEQ ID NO: 4892 - protein, 53 aa, Canis lupus familiaris
PDGARPGGEGPAQRAREEGRARAEPRKEPAEAGHGRQERAGQTSTRQGGQRLL

SEQ ID NO: 4893 - protein, 31 aa, Canis lupus familiaris
PDGLPSSRRHSPTAPARLSPSPPAAPAQQWQ

SEQ ID NO: 4894 - protein, 47 aa, Canis lupus familiaris
PDGSAERGTAAGPRGAGGPAALRALGANATLPLGVPSPESEASGSGR

SEQ ID NO: 4895 - protein, 11 aa, Canis lupus familiaris
PDGVWQITALL

SEQ ID NO: 4896 - protein, 9 aa, Canis lupus familiaris
PDHLRNTQQ

SEQ ID NO: 4897 - protein, 19 aa, Canis lupus familiaris
PDITGQVCWQHLHPQVQVL

SEQ ID NO: 4898 - protein, 46 aa, Canis lupus familiaris
PDLCGGQWTRWLLYRPTLAKAPPPGPCGHLREAACAFRPGALWRGA

SEQ ID NO: 4899 - skipped

SEQ ID NO: 4900 - protein, 19 aa, Canis lupus familiaris
PDPHGHDAATGLQADSLAG

SEQ ID NO: 4901 - protein, 38 aa, Canis lupus familiaris
PDPQAAPAGEGGVHVPLSSRGLRRLQLRRRKGSAAGSV

SEQ ID NO: 4902 - protein, 9 aa, Canis lupus familiaris
PDPQALQDK

SEQ ID NO: 4903 - protein, 10 aa, Canis lupus familiaris
PDPRRPGPVE

SEQ ID NO: 4904 - protein, 20 aa, Canis lupus familiaris
PDPVQPGRGRGRPSPPRAEG

SEQ ID NO: 4905 - protein, 100 aa, Canis lupus familiaris
PDREAPAGLEEGRAERAGGEVVREGGQEFGQEAQEDRAVGRAGEGHHHAERQHQVHHHPQVPGWPAAGVPSEGAPACHLLPPVAMARPAQPPRAAGHGAV

SEQ ID NO: 4906 - protein, 30 aa, Canis lupus familiaris
PDRLGPRHTARPSGCFPQKETGRQGGHGLQ

SEQ ID NO: 4907 - protein, 18 aa, Canis lupus familiaris
PDRPPGNPNLRPPPRAPG

SEQ ID NO: 4908 - protein, 40 aa, Canis lupus familiaris
PDSHDEPGRAELAAAACAGLGLWPLHHQLPRGASLLPPAL

SEQ ID NO: 4909 - protein, 76 aa, Canis lupus familiaris
PDSWDPRASREKQDTLASQDQRVTVGNRVPQAAVVGPEQRVSLVPWDLREDPAPQATLGLQGLQASQVLPGSLQWA

SEQ ID NO: 4910 - protein, 20 aa, Canis lupus familiaris
PDTAAPGPCQVRGRAAGPGL

SEQ ID NO: 4911 - protein, 44 aa, Canis lupus familiaris
PDTAPAPGAAGQQPGHPRTPCRCQPVDLIQPANHVLPASFGDSD

SEQ ID NO: 4912 - protein, 26 aa, Canis lupus familiaris
PDTGSSGSCKHPRSQLPALSVSSIHQ

SEQ ID NO: 4913 - protein, 9 aa, Canis lupus familiaris
PDTQPLGSQ

SEQ ID NO: 4914 - protein, 20 aa, Canis lupus familiaris
PDTSCGLGAGSLELSNIRSS

SEQ ID NO: 4915 - protein, 38 aa, Canis lupus familiaris
PDWACLAPKASVVSPEMPDYLDPQAFPAPPDPQALQDK

SEQ ID NO: 4916 - protein, 36 aa, Canis lupus familiaris
PDYQGPSAGRLLVSLRPRIGVLGPPSMLSGGRPGCT

SEQ ID NO: 4917 - protein, 15 aa, Canis lupus familiaris
PEAAAARAPLPRVAA

SEQ ID NO: 4918 - protein, 86 aa, Canis lupus familiaris
PEAALQLHRAHSHGDPGRARAEGHPERHLPVHHGPLPLLPRQPARLAEQHPPQPLAQRVLRQGAPREGAARQGQLLDAGPPLPGYV

SEQ ID NO: 4919 - protein, 29 aa, Canis lupus familiaris
PEADGLVQPSSQQREGCRGGMGEASNGGG

SEQ ID NO: 4920 - protein, 82 aa, Canis lupus familiaris
PEALPPGQNPRVARSTMHPRGPRSARARRPARWPRPGRGGQAPLRVLLVRSKSGCLMATVSAVPARSSRPFIVSRCRSHRQF

SEQ ID NO: 4921 - protein, 82 aa, Canis lupus familiaris
PEAPADPRLCQTRRGRGPEAVSRAPGRRGTRARSGRPAAPPRHRRAPPRGPGAVGRPSRLQPWGRRRWRSSAWCCAWWAGWA

SEQ ID NO: 4922 - protein, 17 aa, Canis lupus familiaris
PEARGDDSGRLCQVHGI

SEQ ID NO: 4923 - skipped

SEQ ID NO: 4924 - protein, 16 aa, Canis lupus familiaris
PEASRRSPSTRISSLP

SEQ ID NO: 4925 - protein, 13 aa, Canis lupus familiaris
PEASRRSRSTRAS

SEQ ID NO: 4926 - protein, 49 aa, Canis lupus familiaris
PECDRVYLNYPPFNGGHPAAQPAPGPEQHRAPDQPVLPDEGRHQHYLSV

SEQ ID NO: 4927 - protein, 19 aa, Canis lupus familiaris
PECFRWPRNAWNEHGSRWW

SEQ ID NO: 4928 - skipped

SEQ ID NO: 4929 - protein, 9 aa, Canis lupus familiaris
PEDLPGAQG

SEQ ID NO: 4930 - protein, 45 aa, Canis lupus familiaris
PEEACLLGTLQIPAPRHGRRPQLLLVLLLLLFPSGQSRRWPFQDG

SEQ ID NO: 4931 - protein, 64 aa, Canis lupus familiaris
PEEEEEIGTRSLPPAGAAEQQPAPPGPHLQHPKQRLAPCTPARPGCTCAATCQPQCFLCHKPRN

SEQ ID NO: 4932 - protein, 12 aa, Canis lupus familiaris
PEESHAPSTLFL

SEQ ID NO: 4933 - protein, 19 aa, Canis lupus familiaris
PEFTSFAWTILCRQFPLDW

SEQ ID NO: 4934 - skipped

SEQ ID NO: 4935 - protein, 27 aa, Canis lupus familiaris
PEGLCAACTQPPPAFSPVSRGLSGTPS

SEQ ID NO: 4936 - protein, 48 aa, Canis lupus familiaris
PEGPAQAPVHPEPASAGARPFQPGPAHPGGRRAADDRAHAQGDVPDHG

SEQ ID NO: 4937 - protein, 32 aa, Canis lupus familiaris
PEGPGARGPRLPPPEALGAGRAGQDARAPAEV

SEQ ID NO: 4938 - protein, 15 aa, Canis lupus familiaris
PEGPGPAGCDTTGHQ

SEQ ID NO: 4939 - protein, 73 aa, Canis lupus familiaris
PEGRDHPVPAQAVQFSSHLCRWSGLYHSRTVCHSTARFDQAAPVGNATVSFSHDAWQHRIQCRFGCICSDYFS

SEQ ID NO: 4940 - protein, 63 aa, Canis lupus familiaris
PEGRDHPVPAQAVQFSSHLCRWSGLYHSRTVCHSTARFDQAAPVGNATVSFSHDAWQHRIQWH

SEQ ID NO: 4941 - protein, 46 aa, Canis lupus familiaris
PEGRDHPVPAQAVQFSSHLCRWSGQVQHRQRQCELSPHHPVHVPQP

SEQ ID NO: 4942 - protein, 59 aa, Canis lupus familiaris
PEGRDHPVPAQAVQFSSHLCRWSVDQAAPVGNATVSFSHDAWQHRIQCRFGCICSDYFS

SEQ ID NO: 4943 - protein, 49 aa, Canis lupus familiaris
PEGRDHPVPAQAVQFSSHLCRWSVDQAAPVGNATVSFSHDAWQHRIQWH

SEQ ID NO: 4944 - protein, 41 aa, Canis lupus familiaris
PEGRGRAGGRRRPPGRGARAGDPGRGRGGGAGPGARGTRKD

SEQ ID NO: 4945 - skipped

SEQ ID NO: 4946 - protein, 8 aa, Canis lupus familiaris
PEGSDYIR

SEQ ID NO: 4947 - protein, 16 aa, Canis lupus familiaris
PEGSGRAPGPGGPSRK

SEQ ID NO: 4948 - protein, 25 aa, Canis lupus familiaris
PEHPEKGLVQEGFRDAKHFRSPSTS

SEQ ID NO: 4949 - skipped

SEQ ID NO: 4950 - protein, 31 aa, Canis lupus familiaris
PEKGLRGQCWDPESNVTVRGRASRQVRAPKW

SEQ ID NO: 4951 - protein, 63 aa, Canis lupus familiaris
PELGGPALGRRAPRRAPAAGGALAAPGELLPAVAARAGCARRRGLFSGARALGARVDRAYGPR

SEQ ID NO: 4952 - protein, 65 aa, Canis lupus familiaris
PELPILPLRYTQPLSSELSALQVPLGWREHSASDGPLCDAVAVSAAAAERARQWPHHLLDLTGWR

SEQ ID NO: 4953 - protein, 55 aa, Canis lupus familiaris
PELPILPLRYTQVPLGWREHSASDGPLCDAVAVSAAAAERARQWPHHLLDLTGWR

SEQ ID NO: 4954 - protein, 33 aa, Canis lupus familiaris
PELPLGHAFPSGLPRLALDPTGGHFRGARPGYP

SEQ ID NO: 4955 - protein, 42 aa, Canis lupus familiaris
PELPSQLASPLTTCKLASPRTERTAPPGCCPCPPPPMGKVIL

SEQ ID NO: 4956 - protein, 31 aa, Canis lupus familiaris
PELRAAAAGDGDGPGRAGVRPAVRTWHRDGR

SEQ ID NO: 4957 - protein, 12 aa, Canis lupus familiaris
PENPGQRSAGGM

SEQ ID NO: 4958 - protein, 48 aa, Canis lupus familiaris
PEPASCQPAGPEHLLQRPVGGGRLRSGTRPLHPSHWPQLCKEGMPAEL

SEQ ID NO: 4959 - protein, 46 aa, Canis lupus familiaris
PEPCLWPTSMAVRSTTAVPLWTRTQVMASGGEKQQKWLLKYRWTAV

SEQ ID NO: 4960 - protein, 21 aa, Canis lupus familiaris
PEPGLEASRGWKKPLRRRPSG

SEQ ID NO: 4961 - protein, 26 aa, Canis lupus familiaris
PEPHLSPGAGACPASPQCLSPTPWFS

SEQ ID NO: 4962 - protein, 11 aa, Canis lupus familiaris
PEPIHGPVESL

SEQ ID NO: 4963 - protein, 13 aa, Canis lupus familiaris
PEPRLPDLHHHWR

SEQ ID NO: 4964 - protein, 9 aa, Canis lupus familiaris
PEPTWLSQG

SEQ ID NO: 4965 - protein, 14 aa, Canis lupus familiaris
PEQLLCRRMPADED

SEQ ID NO: 4966 - protein, 85 aa, Canis lupus familiaris
PERCDQWERSSSPPPSPPSHSSRAPPPPRAPPSIPCRRGQSTHSRRATLQPGIQKTLCPWKRRQRCTSCTDFCCIIGRLTCIRND

SEQ ID NO: 4967 - skipped

SEQ ID NO: 4968 - protein, 60 aa, Canis lupus familiaris
PERHPRGVHGPSPPPRSGVHGPDHRPRAHVKPVPSRPDTLGAERRGHQRADRVRHRHTDR

SEQ ID NO: 4969 - protein, 28 aa, Canis lupus familiaris
PERMGFRNTGRHCPPRCLPEVISVCGVY

SEQ ID NO: 4970 - protein, 20 aa, Canis lupus familiaris
PERNRGGSRGHWRCHRASTP

SEQ ID NO: 4971 - protein, 25 aa, Canis lupus familiaris
PESGGRQVAHDDAQGSGGNLERAGE

SEQ ID NO: 4972 - protein, 17 aa, Canis lupus familiaris
PESHQQCHSVCEPLGPQ

SEQ ID NO: 4973 - protein, 21 aa, Canis lupus familiaris
PESSEGLPLPQCPGRPSLEPV

SEQ ID NO: 4974 - protein, 40 aa, Canis lupus familiaris
PESSGFLGSQEVGVTRELQGEQAFTARWAPQGTLVTVETS

SEQ ID NO: 4975 - protein, 13 aa, Canis lupus familiaris
PETPVLYSNSTGN

SEQ ID NO: 4976 - protein, 17 aa, Canis lupus familiaris
PETSAPKASRALGGPLA

SEQ ID NO: 4977 - protein, 9 aa, Canis lupus familiaris
PETTSTFRG

SEQ ID NO: 4978 - protein, 69 aa, Canis lupus familiaris
PETTSTFSTQKPWNNTERYYRTQSAFTSSRIHRPRTCWIQCSQTDCSTPCRSDQCPPEPCSGICWKIDS

SEQ ID NO: 4979 - protein, 8 aa, Canis lupus familiaris
PEVKVLTI

SEQ ID NO: 4980 - protein, 24 aa, Canis lupus familiaris
PEVMTLWEIQERHPDSFPENSSLY

SEQ ID NO: 4981 - protein, 30 aa, Canis lupus familiaris
PEVSASLLLGLDPQREGTTPLRRSMPPAHG

SEQ ID NO: 4982 - protein, 22 aa, Canis lupus familiaris
PEWARPSWCGRWPGKPARSCWP

SEQ ID NO: 4983 - protein, 9 aa, Canis lupus familiaris
PFEDGPSRC

SEQ ID NO: 4984 - skipped

SEQ ID NO: 4985 - protein, 23 aa, Canis lupus familiaris
PFHPSRSSCTQRGPLGSLSEPRE

SEQ ID NO: 4986 - protein, 50 aa, Canis lupus familiaris
PFIFVGASTVPFHAGPRTCYLQGHSFQASAELGPWDRSEEPRARAGRRPL

SEQ ID NO: 4987 - protein, 72 aa, Canis lupus familiaris
PFILHLLRTCRGPRPSCSRPRPSGTARPRPPLPLEVQRVPELPAASTHRLRLLPNQLGRLPRAASTDSTDPL

SEQ ID NO: 4988 - protein, 19 aa, Canis lupus familiaris
PFLAWRPLWAPRKMRWQLL

SEQ ID NO: 4989 - protein, 60 aa, Canis lupus familiaris
PFLLPLVNLSHPYVFVFLSTLGPGDPRVSRAVPLLGGHGARVPAAASAGGTGWAQAAARV

SEQ ID NO: 4990 - protein, 45 aa, Canis lupus familiaris
PFLPKIAPLRQAAQRSTAHSQPRRHQGCQKLHRLTGWPREQPQQQ

SEQ ID NO: 4991 - protein, 70 aa, Canis lupus familiaris
PFLQRERENGSNLAFMFRLPFAAGRVFSISMLDTLLYQSFVKDYMISITRLLLGLDTTPGSGYLCAMKVT

SEQ ID NO: 4992 - protein, 20 aa, Canis lupus familiaris
PFLSPQSVASRVPAAEKASL

SEQ ID NO: 4993 - skipped

SEQ ID NO: 4994 - protein, 39 aa, Canis lupus familiaris
PFPGPKGASSRGHRLLPGLGRGCWCPGSRRPRPWARWEP

SEQ ID NO: 4995 - protein, 39 aa, Canis lupus familiaris
PFPRPPPGLRAPFPKLRLCRGRWSPRRDRTRAWWHTGSH

SEQ ID NO: 4996 - protein, 15 aa, Canis lupus familiaris
PFPRRAPRRRPYTLS

SEQ ID NO: 4997 - protein, 24 aa, Canis lupus familiaris
PFPVHPHSRCGSSSHPGEWWWQYQ

SEQ ID NO: 4998 - protein, 18 aa, Canis lupus familiaris
PFQDEPPGGDPILYPKGL

SEQ ID NO: 4999 - protein, 9 aa, Canis lupus familiaris
PFQHVWVTW

SEQ ID NO: 5000 - protein, 18 aa, Canis lupus familiaris
PFQLLGYVLSTPCLGEAC

SEQ ID NO: 5001 - protein, 38 aa, Canis lupus familiaris
PFQLRPAEPGGSSHAPSPALWEPRPRPPQLRVRRGWAA

SEQ ID NO: 5002 - protein, 12 aa, Canis lupus familiaris
PFQRDCDLLGTL

SEQ ID NO: 5003 - protein, 25 aa, Canis lupus familiaris
PFRALYLPTWGIVQIGLCLGCAAGG

SEQ ID NO: 5004 - protein, 30 aa, Canis lupus familiaris
PFRLPTLTTLPQCVLGGARGECNKRRSCGV

SEQ ID NO: 5005 - protein, 78 aa, Canis lupus familiaris
PFRQTPGLAPDPRLHANQVQGASPRAAQSPGEQFCAEPSSSRRRAGPPEDGNQDDPERDRQLVLREAEESGCRGHQEG

SEQ ID NO: 5006 - protein, 10 aa, Canis lupus familiaris
PFRSPRISRS

SEQ ID NO: 5007 - protein, 33 aa, Canis lupus familiaris
PFSDRPVSRTWTFLIHRTAPDFLLSEAQPLPAH

SEQ ID NO: 5008 - protein, 42 aa, Canis lupus familiaris
PFSIRVRGQSRGPRRQEPRKRGSGGRRRRRRGGLLEGRMPAV

SEQ ID NO: 5009 - protein, 16 aa, Canis lupus familiaris
PFSPGPSPSGPCPQLC

SEQ ID NO: 5010 - skipped

SEQ ID NO: 5011 - protein, 22 aa, Canis lupus familiaris
PGAAASSPGSCAATAAAASVPQ

SEQ ID NO: 5012 - protein, 67 aa, Canis lupus familiaris
PGAAFAARAHRRRQTPAGRRPAAQNLVSAGHPQPLPRALRPREPAGADARLPTSRPGSCQAGCENLQ

SEQ ID NO: 5013 - protein, 22 aa, Canis lupus familiaris
PGAAGEWEDAQCRGLQWCGLPG

SEQ ID NO: 5014 - protein, 16 aa, Canis lupus familiaris
PGAANTATALHTASQL

SEQ ID NO: 5015 - protein, 18 aa, Canis lupus familiaris
PGAANTATALHTGTPGMA

SEQ ID NO: 5016 - protein, 14 aa, Canis lupus familiaris
PGACAVRPILVGPV

SEQ ID NO: 5017 - protein, 36 aa, Canis lupus familiaris
PGAEADAGRTFVPTHPNHAFKPGWKNHRHAAGDRQL

SEQ ID NO: 5018 - protein, 16 aa, Canis lupus familiaris
PGAGMASGCGFTAWGP

SEQ ID NO: 5019 - protein, 17 aa, Canis lupus familiaris
PGAGPAAPGAPRSRATC

SEQ ID NO: 5020 - protein, 25 aa, Canis lupus familiaris
PGALAPQPRPARGPQPIGSGKSVPS

SEQ ID NO: 5021 - protein, 28 aa, Canis lupus familiaris
PGALLPGSSPSFSFPHWEPLDLRTSVPG

SEQ ID NO: 5022 - protein, 48 aa, Canis lupus familiaris
PGALPIQSRGPRGKGASEQARARRPEGRSSWPSGRPSRWSRKRRRLGP

SEQ ID NO: 5023 - protein, 77 aa, Canis lupus familiaris
PGAPGAPGRSDCAQPPAPVGPGQRRGLPHSLLHGAGARAAPRRVADLLLVHQPRGHSLRCRKAEALHFLQAAPESHQ

SEQ ID NO: 5024 - protein, 73 aa, Canis lupus familiaris
PGAPRARRAVPCLGPAEAARDPQASLTLSPPTCPPAQQPPKPPGWSPVALWLAWGSWTLGPSWTKIPTVRRSC

SEQ ID NO: 5025 - protein, 13 aa, Canis lupus familiaris
PGAPRGPRVEPPP

SEQ ID NO: 5026 - protein, 38 aa, Canis lupus familiaris
PGAPSPPGSGSPRVRPSVGPLAAPRDMAFIWRNRLLSF

SEQ ID NO: 5027 - skipped

SEQ ID NO: 5028 - protein, 72 aa, Canis lupus familiaris
PGAQRPRRPGWRRWRQGPPAGGLQPGAGGPPPEHVVLQQTTARPRGIPWAPGGWPQPPSRHGGPGHQAAPAH

SEQ ID NO: 5029 - protein, 64 aa, Canis lupus familiaris
PGARGGRGRQSNGGGRPRRAQGAAAGLRARGRPGRPPPQGPLLPREGSQGRALEGQRRAPQRRF

SEQ ID NO: 5030 - protein, 11 aa, Canis lupus familiaris
PGARGRPLLGR

SEQ ID NO: 5031 - protein, 66 aa, Canis lupus familiaris
PGARRARRVRGVRSRAGRHAGDRSGHDGGGRLHLRHAGGHLPARGLHHREPHAPSFRAPRPAQAAL

SEQ ID NO: 5032 - protein, 29 aa, Canis lupus familiaris
PGASGCVCRTTYPIPAPLPAAAAAPGLPP

SEQ ID NO: 5033 - protein, 60 aa, Canis lupus familiaris
PGASGLAVSSHVGVSTGAPVMQPLGPASALLGSWGPTAVCPVHRATSAPAVRMCAGVGRP

SEQ ID NO: 5034 - protein, 49 aa, Canis lupus familiaris
PGATIGLRRGRASPLVGSGNPQSQEESRGAAVQRTPFWSARRSPASPGW

SEQ ID NO: 5035 - protein, 31 aa, Canis lupus familiaris
PGAWTGCAPCKPAPGSPPASSAATRRPAACS

SEQ ID NO: 5036 - protein, 27 aa, Canis lupus familiaris
PGCFRQLSSLAPARGLHSAGLVGHHLS

SEQ ID NO: 5037 - protein, 8 aa, Canis lupus familiaris
PGCFWLCL

SEQ ID NO: 5038 - protein, 21 aa, Canis lupus familiaris
PGCLQLPLAGAGPPREEREGV

SEQ ID NO: 5039 - protein, 47 aa, Canis lupus familiaris
PGCPGLQATGPAAPRPCSRGPLPGLRPRRAAGRPRRACPPSPRPPRA

SEQ ID NO: 5040 - skipped

SEQ ID NO: 5041 - protein, 17 aa, Canis lupus familiaris
PGCQRPPHQHRLCPDPL

SEQ ID NO: 5042 - protein, 10 aa, Canis lupus familiaris
PGCRPGAPPR

SEQ ID NO: 5043 - protein, 33 aa, Canis lupus familiaris
PGCSRPRLQPRRAPCSRRGPGARAVAGPRPRSE

SEQ ID NO: 5044 - protein, 13 aa, Canis lupus familiaris
PGCSVWLCHGCHS

SEQ ID NO: 5045 - protein, 12 aa, Canis lupus familiaris
PGCTATGKASGW

SEQ ID NO: 5046 - protein, 13 aa, Canis lupus familiaris
PGDQGGSRRTWWR

SEQ ID NO: 5047 - skipped

SEQ ID NO: 5048 - protein, 23 aa, Canis lupus familiaris
PGDSRCFCESPQTAHLLDPARAA

SEQ ID NO: 5049 - protein, 12 aa, Canis lupus familiaris
PGECETTSAKGK

SEQ ID NO: 5050 - protein, 30 aa, Canis lupus familiaris
PGEGGTEALLSPPAEGVLPAEPPHGHQDGQ

SEQ ID NO: 5051 - protein, 11 aa, Canis lupus familiaris
PGEGSFYLGPR

SEQ ID NO: 5052 - protein, 41 aa, Canis lupus familiaris
PGEPGEHARGPEHLPGHGHRGGGGGGVERVALRRQEGLRSP

SEQ ID NO: 5053 - protein, 22 aa, Canis lupus familiaris
PGEPPPSSCPRTGKPLSWAGDP

SEQ ID NO: 5054 - protein, 53 aa, Canis lupus familiaris
PGFIPSPLIQQSSCHFPTWAVATSLKYSATGPCSRPDAHLLSDVQATCWVHFA

SEQ ID NO: 5055 - protein, 15 aa, Canis lupus familiaris
PGFKMQSRRRKWAGN

SEQ ID NO: 5056 - protein, 81 aa, Canis lupus familiaris
PGFPASGPPRRGRGRPLSAGEGRDRGGGARAGGAARGLRGPGPVAACGAARRSCPAGAAFSESPPEAAGGRKGSVPCTLPP

SEQ ID NO: 5057 - protein, 42 aa, Canis lupus familiaris
PGFRTSAAWPCWAGDTLGRSSWCNSRARGNTTLSKRSRSRRC

SEQ ID NO: 5058 - protein, 22 aa, Canis lupus familiaris
PGFSLGRHPGSPCHSWGAAPDP

SEQ ID NO: 5059 - protein, 30 aa, Canis lupus familiaris
PGGAGRSGSGSFAACGAAPGCRRPGRASLL

SEQ ID NO: 5060 - protein, 10 aa, Canis lupus familiaris
PGGAPDLRGL

SEQ ID NO: 5061 - protein, 75 aa, Canis lupus familiaris
PGGATSRTPGPPEEEEEIGTRSLPPAGAAEQQPAPPGPHLQHPKQRLAPCTPARPGCTCAATCQPQCFLCHKPRN

SEQ ID NO: 5062 - protein, 66 aa, Canis lupus familiaris
PGGCAQPERPRRRGGGLQGPSSQQAGPRRRGPPRPAGGPRHRRPGPRARPARRRREEPGRGSRGPH

SEQ ID NO: 5063 - protein, 77 aa, Canis lupus familiaris
PGGCSSPCSATTTALAARERHPPAAQQQPSRQKQEPCASCRQGGEACVLPGLCTRGPEAAHGGPMLDVRPALPCAPS

SEQ ID NO: 5064 - protein, 36 aa, Canis lupus familiaris
PGGDPSPGVHPGFPGSDSDLHLCGHWRPHPHHQLEA

SEQ ID NO: 5065 - skipped

SEQ ID NO: 5066 - protein, 24 aa, Canis lupus familiaris
PGGGPSVAAAAAAATAALAPDPGP

SEQ ID NO: 5067 - protein, 85 aa, Canis lupus familiaris
PGGGRGAQQHSREQRALGARPGGPAYPRDEGHVHGALGAAPEQGDRPAQRAAGPQHLALPRPVPRPVLSGRLSRGRPGEATMLRL

SEQ ID NO: 5068-5069 - skipped (2 entries)

SEQ ID NO: 5070 - protein, 20 aa, Canis lupus familiaris
PGGHPSSGTQPFCNEPHRKA

SEQ ID NO: 5071 - protein, 10 aa, Canis lupus familiaris
PGGLLHQCLQ

SEQ ID NO: 5072 - protein, 16 aa, Canis lupus familiaris
PGGLPSALLVHGRRAL

SEQ ID NO: 5073 - protein, 39 aa, Canis lupus familiaris
PGGLQSQSQSQSQSQAWMPPHWLCSKPSSTNRLSYWPGR

SEQ ID NO: 5074 - protein, 28 aa, Canis lupus familiaris
PGGLRASRFQLSRSVRARICCGLPATDE

SEQ ID NO: 5075 - protein, 97 aa, Canis lupus familiaris
PGGPAAESPHGLEGRPAAGGGGGEGGRRGGGGGDHRPGQSHAGCRGAAGESQILSAGQVLFQQRGRFQQADRCGLPQEDPSLGHRLCFRNLPPSRAA

SEQ ID NO: 5076 - protein, 25 aa, Canis lupus familiaris
PGGPEQPRRRRALEAALLGADLRYR

SEQ ID NO: 5077 - protein, 15 aa, Canis lupus familiaris
PGGPPGARGRPLLGR

SEQ ID NO: 5078 - protein, 9 aa, Canis lupus familiaris
PGGPRPCWM

SEQ ID NO: 5079 - protein, 39 aa, Canis lupus familiaris
PGGPVPGAVPGSWPRAQLTPRGLWLSCHPRYPLQLPGIA

SEQ ID NO: 5080 - protein, 76 aa, Canis lupus familiaris
PGGQPLAEQPGLAAPGKAQAWGHLASELSRGRRITSSNRQGALSPQQPPAEGGLLLELHPRLPRQPARLLHLPGGQ

SEQ ID NO: 5081 - protein, 10 aa, Canis lupus familiaris
PGGRLHPLRP

SEQ ID NO: 5082-5083 - skipped (2 entries)

SEQ ID NO: 5084 - protein, 49 aa, Canis lupus familiaris
PGGRTATAPTFHPSPPRGTPTTSEKTGAPRCPSTPGPCTRVGSLCPRTF

SEQ ID NO: 5085 - protein, 87 aa, Canis lupus familiaris
PGGSLPLHCPQDPWRPQPQRHPWGPPSRAWVPAVVGAAARGMGARERGWCRGRRCPKATGGHWPTPSRHIPTSRSSPWPSSRRRARC

SEQ ID NO: 5086 - protein, 35 aa, Canis lupus familiaris
PGGSLWPTLCFVHTRARRPGGILPGSLPPAFACSS

SEQ ID NO: 5087 - protein, 23 aa, Canis lupus familiaris
PGGSSPPAWCWSSSCSTLACGRE

SEQ ID NO: 5088 - protein, 72 aa, Canis lupus familiaris
PGHAGLHGADADPAGAAGLSDGLAHQPAAGRPAGGQGRHAAQHAGALPEPLPEGGEAAPHQGRQTGPRVCLL

SEQ ID NO: 5089 - protein, 71 aa, Canis lupus familiaris
PGHAGLHGADDPAGAAGLSDGLAHQPAAGRPAGGQGRHAAQHAGALPEPLPEGGEAAPHQGRQTGPRVCLL

SEQ ID NO: 5090 - protein, 30 aa, Canis lupus familiaris
PGHCGGRGTTSCTASTSAGTCPTAATTAQT

SEQ ID NO: 5091 - protein, 20 aa, Canis lupus familiaris
PGHCGPWAMPSPRQSCRAWA

SEQ ID NO: 5092 - protein, 89 aa, Canis lupus familiaris
PGHGAYPQESCQPLSNLCPLPKPRSHCPPQGPQAPVPLSGLRVSQMCPHLGAPKGHGCPGGLASATGGTAQETSGSGPDKEKDSSSQSS

SEQ ID NO: 5093-5094 - skipped (2 entries)

SEQ ID NO: 5095 - protein, 24 aa, Canis lupus familiaris
PGHLSPWLSHSPRPSGSLWTWRCS

SEQ ID NO: 5096 - protein, 62 aa, Canis lupus familiaris
PGHSVHGPAVSHAGPVSRALLSHRAQAGLLCRRRAPRCGACAFRGAQPGIHGSPPHRPHKRG

SEQ ID NO: 5097 - protein, 41 aa, Canis lupus familiaris
PGHTGRRPPPAWSLWAQREKSWQEGRRAWASRPRSPCTVSR

SEQ ID NO: 5098 - skipped

SEQ ID NO: 5099 - protein, 13 aa, Canis lupus familiaris
PGICGPSRGPGNS

SEQ ID NO: 5100 - protein, 11 aa, Canis lupus familiaris
PGICHRLPIGV

SEQ ID NO: 5101 - protein, 26 aa, Canis lupus familiaris
PGIRAALRLVQVQSQGESPPGSWNDD

SEQ ID NO: 5102 - protein, 18 aa, Canis lupus familiaris
PGIREDGPGCGEYPTEVC

SEQ ID NO: 5103 - skipped

SEQ ID NO: 5104 - protein, 47 aa, Canis lupus familiaris
PGLAQGRPPLPREAAPAPLATLGPEPKTPGYLHPHGRGCRLPGQQPR

SEQ ID NO: 5105 - protein, 85 aa, Canis lupus familiaris
PGLARRAGRRGEQQGSSSSNWRRPAPELTPPIRPHLLQAFAPRDVWGAGTWGRGRAPSCGPANHTGLGPGASSRRDWGIRGYFAA

SEQ ID NO: 5106 - protein, 11 aa, Canis lupus familiaris
PGLCDCAGAGV

SEQ ID NO: 5107 - protein, 45 aa, Canis lupus familiaris
PGLHGCSETSPGRASNTSRAGAGPGVGPEREGRGSGGCSSRAGRG

SEQ ID NO: 5108 - protein, 26 aa, Canis lupus familiaris
PGLHQEAPKPGRHCLPWGVWPRPWQL

SEQ ID NO: 5109 - protein, 15 aa, Canis lupus familiaris
PGLIEAPHPSWIPDS

SEQ ID NO: 5110 - protein, 15 aa, Canis lupus familiaris
PGLKPLTCFRFSSML

SEQ ID NO: 5111 - protein, 86 aa, Canis lupus familiaris
PGLLEPWDRQDLQVPQVLWAQLVSLDSKAHAASEDLLANRSWAAAAPSLSSSLPKVLTYGVPQAHLDHQGLQEKAGRARRALRDLC

SEQ ID NO: 5112 - protein, 85 aa, Canis lupus familiaris
PGLLEPWDRQDLQVPQVLWAQLVSLDSKAHAASEDLLANRSWAAAAPSLSSSLPVLTYGVPQAHLDHQGLQEKAGRARRALRDLC

SEQ ID NO: 5113 - protein, 32 aa, Canis lupus familiaris
PGLLFSSGDDEETCSRCQGPPPRAGARVASKQ

SEQ ID NO: 5114 - protein, 49 aa, Canis lupus familiaris
PGLNFSPKPGDRYSVDQAVWAGPAPEEAAGGDRPEAGGKGAARSSLGVN

SEQ ID NO: 5115 - protein, 23 aa, Canis lupus familiaris
PGLPKASPPAPSMPRSSLRRTRC

SEQ ID NO: 5116 - protein, 17 aa, Canis lupus familiaris
PGLPQRLLFRQPRPFSL

SEQ ID NO: 5117 - protein, 46 aa, Canis lupus familiaris
PGLPVAPPPPPPPPPPPRRIARGGRRAATRGASRRGGLRWNPGARR

SEQ ID NO: 5118 - protein, 18 aa, Canis lupus familiaris
PGLQHALLPSSPPHIPWL

SEQ ID NO: 5119 - protein, 36 aa, Canis lupus familiaris
PGLRAPSSWATRPAAPEGTPQRRLAAAPLQTAQRRF

SEQ ID NO: 5120 - protein, 100 aa, Canis lupus familiaris
PGLRGAAGAHGAACRGRARGGGHSRPRGQRGSDSGQAAAAAAGAGSADHLRGVWQGLQPQHGPGAPPGHAHGRAAAPLRRVRQGLLAALQPGDAPAHPHR

SEQ ID NO: 5121 - protein, 8 aa, Canis lupus familiaris
PGLRPPSL

SEQ ID NO: 5122 - protein, 34 aa, Canis lupus familiaris
PGLWGHCWHRPGFPTGPGPPSIASLQVHPLPVQF

SEQ ID NO: 5123 - protein, 49 aa, Canis lupus familiaris
PGLWQVLPTPGGLQAAGGHEHALEQRRHRHLQRHALRAGPHGPQDQDGR

SEQ ID NO: 5124 - protein, 15 aa, Canis lupus familiaris
PGMRRLTTSPPTRSS

SEQ ID NO: 5125 - protein, 9 aa, Canis lupus familiaris
PGMTTSSGW

SEQ ID NO: 5126 - protein, 15 aa, Canis lupus familiaris
PGMWPPPPGHVRPPL

SEQ ID NO: 5127 - protein, 12 aa, Canis lupus familiaris
PGNSPCSPPSTL

SEQ ID NO: 5128 - skipped

SEQ ID NO: 5129 - protein, 25 aa, Canis lupus familiaris
PGNWDPGSRTPPPPTGRPTWKARLT

SEQ ID NO: 5130 - protein, 12 aa, Canis lupus familiaris
PGPAAVWNLETS

SEQ ID NO: 5131 - protein, 68 aa, Canis lupus familiaris
PGPAEPRGRGTSLSPAGGQPWRAAAPSEEAVSDAGRQGQPRWPGPRPAQEEEEEAAGSEASRGVCGAE

SEQ ID NO: 5132 - protein, 9 aa, Canis lupus familiaris
PGPAPGARS

SEQ ID NO: 5133 - protein, 45 aa, Canis lupus familiaris
PGPARPSAVPGAQSRPSPRPPSRCGTRTALPKTSSPGYRRSGEII

SEQ ID NO: 5134 - protein, 10 aa, Canis lupus familiaris
PGPAVPPRTG

SEQ ID NO: 5135 - protein, 45 aa, Canis lupus familiaris
PGPCRHWRPRWGSTARCGTPRSPATGPSSTASGSSRSPRSSCSAS

SEQ ID NO: 5136 - protein, 22 aa, Canis lupus familiaris
PGPDPGGGGVASASHAAAVQLL

SEQ ID NO: 5137 - protein, 57 aa, Canis lupus familiaris
PGPEGLRESRAGRVPRVLPAQAPAGWRPLPATCLASPSTRVCGGRTRVTRCCASTTW

SEQ ID NO: 5138-5139 - skipped (2 entries)

SEQ ID NO: 5140 - protein, 33 aa, Canis lupus familiaris
PGPGPSPPHSSSRPSQAGRSCGAWRASASGGRP

SEQ ID NO: 5141 - protein, 15 aa, Canis lupus familiaris
PGPGQPGAPGALGEH

SEQ ID NO: 5142 - protein, 40 aa, Canis lupus familiaris
PGPKCPPWPGASCSGRSASRPAAGPRSAATATTSSGAPFW

SEQ ID NO: 5143 - skipped

SEQ ID NO: 5144 - protein, 9 aa, Canis lupus familiaris
PGPPAPRPT

SEQ ID NO: 5145 - skipped

SEQ ID NO: 5146 - protein, 26 aa, Canis lupus familiaris
PGPPGWGHPQGSQPGALTPGGEQGGQ

SEQ ID NO: 5147 - skipped

SEQ ID NO: 5148 - protein, 40 aa, Canis lupus familiaris
PGPPRPPPPRCPPPRPRRPPCTARSPPTATPRATRPRRRP

SEQ ID NO: 5149 - protein, 52 aa, Canis lupus familiaris
PGPQCLPGPVRGSDCPPPMALLHLPGCLEPVGPGRLAPSSLRRLLEPGHPLS

SEQ ID NO: 5150 - protein, 37 aa, Canis lupus familiaris
PGPQYGAGASQRPGGHLPPPTDHGKASASSWGEKARR

SEQ ID NO: 5151 - protein, 86 aa, Canis lupus familiaris
PGPRCGQPWMSKCCRRGSRPHSLRGQPSVLRAHYGCLSPPSPLCGCSSWSAWASRQSRQWWHWLPQAEWRVLCHCWLAGRWALRPW

SEQ ID NO: 5152 - protein, 80 aa, Canis lupus familiaris
PGPRPPCCGPGPWSCSLPCPCLHSRVGTCAPVVPTARCGKQSLWGGRTTPASCRSALCPSSPVLRTRDGPGGSASHDHCG

SEQ ID NO: 5153 - protein, 55 aa, Canis lupus familiaris
PGPRRGGAEQLHLHGRQRVLHPHRPQRSLHFASGWQWPPLHPGGWLGHQPGPGCG

SEQ ID NO: 5154 - protein, 41 aa, Canis lupus familiaris
PGPRTARRPFASTGAPVTWGCRATWSACALSSSWASTARAG

SEQ ID NO: 5155 - protein, 28 aa, Canis lupus familiaris
PGPRWAAPGGRGRGTGSRPPAARSTTAT

SEQ ID NO: 5156 - protein, 30 aa, Canis lupus familiaris
PGPSQAKEEDGAREDRGAGAASGGFRFRGR

SEQ ID NO: 5157 - protein, 47 aa, Canis lupus familiaris
PGPSRAQVQPGTQEQPGSRRAPGRGPDPGRGCRLPPRGGGGQAGRPG

SEQ ID NO: 5158 - protein, 46 aa, Canis lupus familiaris
PGPSWRRPSSLDEEDRTVPAPRTEASPEPSVPWAALGRKGASLQDP

SEQ ID NO: 5159 - protein, 16 aa, Canis lupus familiaris
PGPTHPSPPLACRTGC

SEQ ID NO: 5160 - protein, 15 aa, Canis lupus familiaris
PGPVEAPGNSLNGGT

SEQ ID NO: 5161 - protein, 59 aa, Canis lupus familiaris
PGPVVATTAAAVTSTAASPTSSAPASPRPWTRCPRCAPSWTGSAGTSSCFLEICMVAQW

SEQ ID NO: 5162 - protein, 85 aa, Canis lupus familiaris
PGPVVTGDQDGGVPQDVEPHGAPRLGPAVPRAVHPVLQGAAAPPPNTGIPLQPCGEGSFGGFCSPRGLLHLVPLPPHPGPAAGLV

SEQ ID NO: 5163 - protein, 14 aa, Canis lupus familiaris
PGQAAPQGLSAAKA

SEQ ID NO: 5164 - protein, 17 aa, Canis lupus familiaris
PGQAVFHLQSHGDVAQC

SEQ ID NO: 5165 - protein, 36 aa, Canis lupus familiaris
PGQGSPPRSPSPRQACCHRRPRPCTHCRETPTAHRS

SEQ ID NO: 5166 - skipped

SEQ ID NO: 5167 - protein, 40 aa, Canis lupus familiaris
PGQQPRGRHPEPEGEPGRRHQGSQPQGGAGGASDGGRWPG

SEQ ID NO: 5168 - skipped

SEQ ID NO: 5169 - protein, 49 aa, Canis lupus familiaris
PGQRPLHARGAHAGPGIQAEKPAPAKAELCSAPWGCPGTAGWRRQWRSS

SEQ ID NO: 5170 - protein, 48 aa, Canis lupus familiaris
PGQRPLHARGAHGPGIQAEKPAPAKAELCSAPWGCPGTAGWRRQWRSS

SEQ ID NO: 5171 - protein, 10 aa, Canis lupus familiaris
PGQSRPLETA

SEQ ID NO: 5172 - protein, 30 aa, Canis lupus familiaris
PGQTGRQAASRLQVWQAGGQAVTQGGVQPQ

SEQ ID NO: 5173 - skipped

SEQ ID NO: 5174 - protein, 45 aa, Canis lupus familiaris
PGRAQAPHTHHQDHPRQGGAAEPGAPAQVAAVHRGAGGDYLRLGH

SEQ ID NO: 5175 - protein, 44 aa, Canis lupus familiaris
PGRARSAVSGALARRLRMARCGPRPGVYPEQASTSRHSQPHRVL

SEQ ID NO: 5176 - protein, 45 aa, Canis lupus familiaris
PGRCAEGLRGSPVTRAAGTPPRMAGGGCIAATLTAAGKFTPKAPT

SEQ ID NO: 5177 - skipped

SEQ ID NO: 5178 - protein, 38 aa, Canis lupus familiaris
PGRGGATDRGEKAPPQPHRIHPVAAAGAGGRFPSHSVP

SEQ ID NO: 5179 - protein, 39 aa, Canis lupus familiaris
PGRGLLPRPFPAPLHLYLRGHRLLDHLLHLHLHPPAAGL

SEQ ID NO: 5180 - protein, 23 aa, Canis lupus familiaris
PGRGLQFPLGPFCAQAPPQPAAE

SEQ ID NO: 5181 - skipped

SEQ ID NO: 5182 - protein, 63 aa, Canis lupus familiaris
PGRGRCPCARPWSRARRRTRPPCGAPPTGRCWAACWRFSGRGASRNSTTRWPSTTRSTARSSA

SEQ ID NO: 5183 - protein, 42 aa, Canis lupus familiaris
PGRGRFSPPLRPRRAEKAAQPGAGGRGQPGPLSGSGNPMGVR

SEQ ID NO: 5184 - protein, 69 aa, Canis lupus familiaris
PGRGSPNLSSMTPRSWLMAVAEQLERNGQLTCGAWAASSGKSSMGPYLGRLPCATLGRSPSRWCPITVN

SEQ ID NO: 5185 - skipped

SEQ ID NO: 5186 - protein, 15 aa, Canis lupus familiaris
PGRLGWHVGRDAATP

SEQ ID NO: 5187 - skipped

SEQ ID NO: 5188 - protein, 91 aa, Canis lupus familiaris
PGRNCRTSRLSPAMHTSPSGSRSKWWGCSLGTTAVVSPAEGAFTSPSRGRSEPLTSPRPLTPRSCWLPLPPGSRSSRPSFQGASPPLTSCS

SEQ ID NO: 5189 - protein, 71 aa, Canis lupus familiaris
PGRPARGPGMSWMNAAPPSPRPPAAALAGGWRRGGAQTLTGPPPSLPPPAGPLRPPGVAPGALVRTGPAPP

SEQ ID NO: 5190 - protein, 9 aa, Canis lupus familiaris
PGRPCAGGC

SEQ ID NO: 5191 - protein, 39 aa, Canis lupus familiaris
PGRPDPGHQDISLHVTEALHFSLCPLQPGHCPGCGLSVL

SEQ ID NO: 5192 - protein, 60 aa, Canis lupus familiaris
PGRPEARPPQPAPSGRDPLWGEALGSQTPVFPTHHGEAEPDLGAPSGETRSPRGLPEGLS

SEQ ID NO: 5193 - protein, 10 aa, Canis lupus familiaris
PGRPPESAPL

SEQ ID NO: 5194 - skipped

SEQ ID NO: 5195 - protein, 17 aa, Canis lupus familiaris
PGRPRSPPLRQPELRPQ

SEQ ID NO: 5196 - protein, 18 aa, Canis lupus familiaris
PGRRDDARRELQLAWARH

SEQ ID NO: 5197 - skipped

SEQ ID NO: 5198 - protein, 25 aa, Canis lupus familiaris
PGRRGCHLSATSTRWRPRASSPTST

SEQ ID NO: 5199 - protein, 60 aa, Canis lupus familiaris
PGRRGQCHGRRHDPDRPRGQDPQGQELESRENHDGQSGHLPGLPEKVRQGAHPRGLPKSV

SEQ ID NO: 5200 - protein, 51 aa, Canis lupus familiaris
PGRRPPRGRARAPTPAGSGAPTRAGNPPSPPAPRFVSGGVALRRSRSHKSP

SEQ ID NO: 5201 - protein, 18 aa, Canis lupus familiaris
PGRRRRRLPQAGVPVARV

SEQ ID NO: 5202 - protein, 20 aa, Canis lupus familiaris
PGRSAARGRGRPTGPARCAS

SEQ ID NO: 5203 - protein, 28 aa, Canis lupus familiaris
PGSARAQCMVGACRSPATHPWQSLPRGP

SEQ ID NO: 5204 - protein, 37 aa, Canis lupus familiaris
PGSEDSDQVPGWGSILTGPAVPGGPRQASAGQGRHGD

SEQ ID NO: 5205 - protein, 59 aa, Canis lupus familiaris
PGSGEEVSGQSGLQEAPSHGSACGRRQHRPLQFYPHGSDPHSPGHQDRQGRSRQTADGR

SEQ ID NO: 5206 - protein, 20 aa, Canis lupus familiaris
PGSGRRPCSAPLASRFSATR

SEQ ID NO: 5207 - protein, 33 aa, Canis lupus familiaris
PGSLIASLDPSLGTKLPSPSQEPSLRMRLLLFT

SEQ ID NO: 5208 - protein, 46 aa, Canis lupus familiaris
PGSPEGAPHLPAVGDRSLCGPSTAPARSTHAIPRLRAYPASLWSHR

SEQ ID NO: 5209 - protein, 27 aa, Canis lupus familiaris
PGSPGGLGAAGSSRGAAVPTGGGLRRS

SEQ ID NO: 5210 - protein, 31 aa, Canis lupus familiaris
PGSPWLPGPHPLPEPSGHVECVPSVATTQRQ

SEQ ID NO: 5211 - protein, 69 aa, Canis lupus familiaris
PGSRPGPCRAPCRPQCCPSGPQHRASEGRGPTHQNGRFQGLASRDEHIGGGEVSEAGGGGLLQILYPGV

SEQ ID NO: 5212 - protein, 27 aa, Canis lupus familiaris
PGSSGPWAWLGSPRQPGGGGGAGTGRG

SEQ ID NO: 5213-5214 - skipped (2 entries)

SEQ ID NO: 5215 - protein, 17 aa, Canis lupus familiaris
PGSSPVGWKSAATGTGG

SEQ ID NO: 5216 - protein, 10 aa, Canis lupus familiaris
PGSSWCPRQK

SEQ ID NO: 5217 - protein, 13 aa, Canis lupus familiaris
PGSTRHLRRGLQQ

SEQ ID NO: 5218 - protein, 85 aa, Canis lupus familiaris
PGTAAAAGLLPAQPARRQERALRRLRLLRPERVRDGCALVDLRGGVLVPGRGPRGAAGDGGGPGRRPARRGVGALLLRRPLRGQV

SEQ ID NO: 5219 - protein, 9 aa, Canis lupus familiaris
PGTCPCLRP

SEQ ID NO: 5220 - protein, 30 aa, Canis lupus familiaris
PGTFSTSQAWARPWRWWTWVGPRTGSCAVP

SEQ ID NO: 5221 - protein, 27 aa, Canis lupus familiaris
PGTGGSGDHGAGDDSLQFCTGCSTSQE

SEQ ID NO: 5222 - protein, 8 aa, Canis lupus familiaris
PGTLRLRV

SEQ ID NO: 5223 - protein, 33 aa, Canis lupus familiaris
PGTPRPRPPDPSPGACPPSPSEGGPQPCLSPLQ

SEQ ID NO: 5224 - protein, 39 aa, Canis lupus familiaris
PGTRAATSTISRTSPSLSTRPSPSRSPPASSPTSTCSWP

SEQ ID NO: 5225 - protein, 16 aa, Canis lupus familiaris
PGTRALCPGAPGSSAE

SEQ ID NO: 5226 - protein, 60 aa, Canis lupus familiaris
PGTSCPVSLRLTGRPSPPRQVQPAPRPRPRPRPHPRTRPRPRSPRVARSSWPSSETPPPG

SEQ ID NO: 5227 - protein, 12 aa, Canis lupus familiaris
PGTSPWSAASLP

SEQ ID NO: 5228 - skipped

SEQ ID NO: 5229 - protein, 14 aa, Canis lupus familiaris
PGVPGVRQELQPQL

SEQ ID NO: 5230 - protein, 13 aa, Canis lupus familiaris
PGVPWLSCLLPGR

SEQ ID NO: 5231 - skipped

SEQ ID NO: 5232 - protein, 44 aa, Canis lupus familiaris
PGWAGRLSFRKAHSQARLGASGDQQALRGSSGTPSPSPPPCQEY

SEQ ID NO: 5233 - skipped

SEQ ID NO: 5234 - protein, 34 aa, Canis lupus familiaris
PGWQICALCSGGSCQLHQHPPDEAEGTAGGHPSD

SEQ ID NO: 5235 - protein, 93 aa, Canis lupus familiaris
PGWSHLTRASSWASPAPRAPWDLLARASGLSALCGEPSRSPGSVLLCPAPAPPRALTVLQAVWPPPCSHALLLPRALTAFLCLLPSRAPGPCL

SEQ ID NO: 5236 - protein, 12 aa, Canis lupus familiaris
PHAATGPSPHQP

SEQ ID NO: 5237 - protein, 36 aa, Canis lupus familiaris
PHALLPPRLWKWAHSGLWTALWMGCSQLRRPKSTWR

SEQ ID NO: 5238 - protein, 34 aa, Canis lupus familiaris
PHAPLARPCPRKRSSPEAGGAASDRARASSAASL

SEQ ID NO: 5239 - protein, 20 aa, Canis lupus familiaris
PHAPLPTALPRAPTSPRASA

SEQ ID NO: 5240 - protein, 9 aa, Canis lupus familiaris
PHAPWWWTR

SEQ ID NO: 5241 - protein, 9 aa, Canis lupus familiaris
PHCCLPGPW

SEQ ID NO: 5242 - protein, 67 aa, Canis lupus familiaris
PHCGPLTPLPVPRPSSPPPKKTCSKATFGTSLSPFATPTRSGTCCWAWTAPTAWTAAWTPCWGTCWL

SEQ ID NO: 5243 - protein, 35 aa, Canis lupus familiaris
PHCSVLTPLVGPPSSTSKVLRSRQQWPRRRPWICC

SEQ ID NO: 5244 - protein, 83 aa, Canis lupus familiaris
PHEAAAGTTVVSGTGTETVIENGIETVIGTGTAIGTGTAIGTGTVIGTGTAIENERALSAGRIHSLNAGPLGRVILSMCMERT

SEQ ID NO: 5245 - protein, 38 aa, Canis lupus familiaris
PHEPPEAPSRAPSTPRPRPSGMIGACARGRVSSSPEGA

SEQ ID NO: 5246 - protein, 16 aa, Canis lupus familiaris
PHFGGGGTWKGSPSRH

SEQ ID NO: 5247 - protein, 34 aa, Canis lupus familiaris
PHFLLLPICMLAIYFSIQPNTIRKSISYFARRPF

SEQ ID NO: 5248 - protein, 22 aa, Canis lupus familiaris
PHFLPSLLHPSPQGQGLPGPQT

SEQ ID NO: 5249 - protein, 18 aa, Canis lupus familiaris
PHFRRPDSATQKFSLFRT

SEQ ID NO: 5250 - protein, 8 aa, Canis lupus familiaris
PHGLPEEP

SEQ ID NO: 5251 - protein, 41 aa, Canis lupus familiaris
PHGPAPPARILCTVHVSIPTRSSPETPAPAASTPARLHPPV

SEQ ID NO: 5252 - protein, 22 aa, Canis lupus familiaris
PHGRRTGTRAAGAPTTTTQTRA

SEQ ID NO: 5253 - protein, 13 aa, Canis lupus familiaris
PHGSREPWGGGGL

SEQ ID NO: 5254 - protein, 20 aa, Canis lupus familiaris
PHHFLPPPCLCLPPLCQLRP

SEQ ID NO: 5255 - protein, 53 aa, Canis lupus familiaris
PHHQGQGAFPPDPVPESREERQENHWPAVRDPEKVQPPQLGAPGPAPSRGPGG

SEQ ID NO: 5256 - protein, 13 aa, Canis lupus familiaris
PHHRQAVPSLPPR

SEQ ID NO: 5257 - protein, 39 aa, Canis lupus familiaris
PHHRRVPIPQERGPQLVPSKGPLRTRRFCREASKSSRAC

SEQ ID NO: 5258 - protein, 50 aa, Canis lupus familiaris
PHICISRCCLPMYGYFQQRPVHCHQWRKWLWEDRECPPDCSAFDFLGKGQ

SEQ ID NO: 5259 - protein, 10 aa, Canis lupus familiaris
PHISPQLDQG

SEQ ID NO: 5260 - protein, 27 aa, Canis lupus familiaris
PHKWTLQPSPSWILWLPHGQILGSSLS

SEQ ID NO: 5261 - protein, 26 aa, Canis lupus familiaris
PHLCHHRHRLQEYDARPRGPVHFVHG

SEQ ID NO: 5262 - skipped

SEQ ID NO: 5263 - protein, 32 aa, Canis lupus familiaris
PHLHLGWAQGRALGWLWGEQPSTPRRTWTRCP

SEQ ID NO: 5264 - protein, 39 aa, Canis lupus familiaris
PHLIFCPGVLRRKYPTALGAARLVHLLQQLREKAIELYH

SEQ ID NO: 5265 - protein, 16 aa, Canis lupus familiaris
PHLLHHLFHLPCQLLH

SEQ ID NO: 5266 - protein, 9 aa, Canis lupus familiaris
PHLLPIAGS

SEQ ID NO: 5267 - protein, 68 aa, Canis lupus familiaris
PHLLTSQGTSLPKPCHPLPCPHLPHHPQPGRLGPWALPGCSWWSSQPLWNRPMQLILRTSTGARVARR

SEQ ID NO: 5268 - protein, 28 aa, Canis lupus familiaris
PHLPLRLPLPPSLHLDFLRHPRPKTIAL

SEQ ID NO: 5269 - protein, 11 aa, Canis lupus familiaris
PHLQPHSVSLP

SEQ ID NO: 5270 - protein, 70 aa, Canis lupus familiaris
PHLRYPACPPCLRCHACPHHLRNLPCPHHPKSPPHPLHLRLPACSHHLRTPRLPRRLKTHLLLRHRRTYS

SEQ ID NO: 5271 - protein, 16 aa, Canis lupus familiaris
PHMIHWQHMRMKEMDQ

SEQ ID NO: 5272 - protein, 21 aa, Canis lupus familiaris
PHMLLQGHSNSPQTAGSAMPV

SEQ ID NO: 5273 - protein, 24 aa, Canis lupus familiaris
PHPAAVALASAPAQTEAARPPTPR

SEQ ID NO: 5274 - protein, 15 aa, Canis lupus familiaris
PHPALPGGGCQDPEW

SEQ ID NO: 5275 - protein, 18 aa, Canis lupus familiaris
PHPAMLPISTKWIWRRCL

SEQ ID NO: 5276 - protein, 11 aa, Canis lupus familiaris
PHPAPRRTPVS

SEQ ID NO: 5277 - protein, 34 aa, Canis lupus familiaris
PHPAQLSPPTTSTPCWVTSCESSSTTWALTRPHG

SEQ ID NO: 5278 - protein, 58 aa, Canis lupus familiaris
PHPDCSPPRALGRPSRRRRWEATRRPRTTMQKSLRATGHLQWPKSPRVPTCLRHGPQT

SEQ ID NO: 5279 - protein, 45 aa, Canis lupus familiaris
PHPGAPPQSPMPTRSSSTCPWERDPRPRRAPPTTGSPPASRTGPT

SEQ ID NO: 5280 - protein, 17 aa, Canis lupus familiaris
PHPGLQPKSLFWATHGQ

SEQ ID NO: 5281 - protein, 39 aa, Canis lupus familiaris
PHPGPRHPLLIVCTQALSCPGLKPRRACQKQSTITNMGT

SEQ ID NO: 5282 - protein, 21 aa, Canis lupus familiaris
PHPGPSGRPRVCWLVVWLREN

SEQ ID NO: 5283 - protein, 31 aa, Canis lupus familiaris
PHPHLDQKGFKHGAQASWLPTRGCSLCPGPE

SEQ ID NO: 5284 - protein, 15 aa, Canis lupus familiaris
PHPHLDQKGFKHGPE

SEQ ID NO: 5285 - skipped

SEQ ID NO: 5286 - protein, 17 aa, Canis lupus familiaris
PHPHPPASASAASNAHL

SEQ ID NO: 5287 - protein, 11 aa, Canis lupus familiaris
PHPHPRVHWAP

SEQ ID NO: 5288 - protein, 9 aa, Canis lupus familiaris
PHPLGLHPL

SEQ ID NO: 5289 - protein, 51 aa, Canis lupus familiaris
PHPLHPIALPHPPVLPPLRFHPHRPPFPLPLTPHLPAGRHPPPDLLPGLLS

SEQ ID NO: 5290 - protein, 97 aa, Canis lupus familiaris
PHPLSQPPAPWSLPALESLGRSGWLLACWLPPWRGRTRWRRSASQEPGAHWGSASSGALTTPATRLVSRSLACSSPRCSHGAWPHVVAFELGTAFWQ

SEQ ID NO: 5291 - protein, 63 aa, Canis lupus familiaris
PHPLTRSWPSCWPSQKWASSTSTARAIGATCPQAPGRHQGRPGLLNPRTRKSPGTAATTRRTH

SEQ ID NO: 5292 - protein, 13 aa, Canis lupus familiaris
PHPPAPPQLPQAG

SEQ ID NO: 5293 - protein, 99 aa, Canis lupus familiaris
PHPPGPNPPTPRPAVGTIWSLRSRVPHFCPHLPRTASPIMPRLTLSPCRASQGATPMLCPRCPQGLPGMGLPEWISLDLGSASRRSLARASLGRCTCVR

SEQ ID NO: 5294 - protein, 36 aa, Canis lupus familiaris
PHPPGWRGLSGAVSPLRSLGLHARASPHPPWRLRPY

SEQ ID NO: 5295 - protein, 91 aa, Canis lupus familiaris
PHPPPPMAPSALHPAFAATPTVRGTAVRTACMTHSRTMGMRVPTRTAALSIALAPQPPPTRRRASTVTAATVSSSGMVGLQLHQQVEIMQR

SEQ ID NO: 5296 - protein, 37 aa, Canis lupus familiaris
PHPPSRTSTCTSPALRRAPGARPLLRPSPSTSTRTRR

SEQ ID NO: 5297 - protein, 85 aa, Canis lupus familiaris
PHPPTRAGRRPLGLCPLHPGSSPADPSPLAVPMPNPRLCYCPALRTNGAQARGNPQTRGVGKPSRAGAGRRGPGVGGAGFLPSHL

SEQ ID NO: 5298 - protein, 13 aa, Canis lupus familiaris
PHPQPQPQWGPRA

SEQ ID NO: 5299 - skipped

SEQ ID NO: 5300 - protein, 93 aa, Canis lupus familiaris
PHPREGGFLPQHLLPPQSPGPHLHCLRGAPPSQCPVALAAMDTLQDLHQAQPQPAAAERPHATVPGLARGDHPGCREPHREPGHLDRVCGGEE

SEQ ID NO: 5301 - protein, 79 aa, Canis lupus familiaris
PHPRGRGRRCQAPYLGALPGRPSLPRAPRAPVARARGPAARPHLPPGGGVPAKDTAGGSGGIGNRLWQRPAPHRGDLGS

SEQ ID NO: 5302 - skipped

SEQ ID NO: 5303 - protein, 67 aa, Canis lupus familiaris
PHPVILTPPKMKRQRPHSLSLHLFSLCPCPAPPPQTVISMRIFAAFAGKVASCLCVTHVPVCIIWTA

SEQ ID NO: 5304 - protein, 17 aa, Canis lupus familiaris
PHPVRTLGWSSEWYSRC

SEQ ID NO: 5305 - protein, 45 aa, Canis lupus familiaris
PHPWLRMPLGEQTLPSPVPGCEGMGSPGAHPATLWPTPSTAQGPP

SEQ ID NO: 5306 - skipped

SEQ ID NO: 5307 - protein, 14 aa, Canis lupus familiaris
PHQCRRVPSAVRRN

SEQ ID NO: 5308 - protein, 45 aa, Canis lupus familiaris
PHQDGVVVARLGTGRPAPRAAAETCLGFARLCHPMNPGDQEARGG

SEQ ID NO: 5309 - protein, 58 aa, Canis lupus familiaris
PHQGQLGPNVSRPSRHPRLGPISSLQDAAGPGEVLPDSWSCPQPWPSWQGPGSCRCAF

SEQ ID NO: 5310 - protein, 37 aa, Canis lupus familiaris
PHQMTLMCWLGAPFCSTHPHERTGRPRVLLPPSALLA

SEQ ID NO: 5311 - skipped

SEQ ID NO: 5312 - protein, 22 aa, Canis lupus familiaris
PHQQQLPPPFLPHSPHCPLVAS

SEQ ID NO: 5313 - protein, 19 aa, Canis lupus familiaris
PHREGSPTAEAGCLAGGRG

SEQ ID NO: 5314 - protein, 47 aa, Canis lupus familiaris
PHRGAAAARARATAAGHPHLLQDQRAGSVGVPSPRTAVQSGDPPPRP

SEQ ID NO: 5315 - protein, 19 aa, Canis lupus familiaris
PHRHLSTSCPPRHLARSQR

SEQ ID NO: 5316 - protein, 39 aa, Canis lupus familiaris
PHRHLSTSCPPRHLARSQRPLSTLPRGAPPGRNRRPPWS

SEQ ID NO: 5317 - protein, 40 aa, Canis lupus familiaris
PHRHLSTSCPPRHLARSQSRPLSTLPRGAPPGRNRRPPWS

SEQ ID NO: 5318 - protein, 8 aa, Canis lupus familiaris
PHRLASCK

SEQ ID NO: 5319 - protein, 25 aa, Canis lupus familiaris
PHRPHGRHQSHSWGLMQPSLTWTRW

SEQ ID NO: 5320 - protein, 64 aa, Canis lupus familiaris
PHRPLLPPRRPPKQPPPQPHRPRQTITITTSSTCSAVAIMVAVVGSTGSSRHKLQPLGTRGTQP

SEQ ID NO: 5321 - protein, 13 aa, Canis lupus familiaris
PHRRGMAMILAGI

SEQ ID NO: 5322 - protein, 12 aa, Canis lupus familiaris
PHRRHWTVLPAV

SEQ ID NO: 5323 - protein, 92 aa, Canis lupus familiaris
PHRRPRQGPHSPLHKCKCRPRHPRRSRAPSWPRSRPRGPEPCSRAPPWPTSRWPGSCRRKGRCRLRRPSPLRWRLRSLQWCPCLRPWSPRQV

SEQ ID NO: 5324 - protein, 99 aa, Canis lupus familiaris
PHRRPRQGPHSPLHKCKCRPRHPRRSRAPSWPRSRPRGPEPCSRAPPWPTSRWPGSPGFPLRSCRRKGRCRLRRPSPLRWRLRSLQWCPCLRPWSPRQV

SEQ ID NO: 5325 - protein, 19 aa, Canis lupus familiaris
PHRWAPCSPAWTGSNRTSS

SEQ ID NO: 5326 - protein, 12 aa, Canis lupus familiaris
PHRWLCPGRPPQ

SEQ ID NO: 5327 - protein, 39 aa, Canis lupus familiaris
PHSALRTGQPPGEHSTARPRPLPRTAPCGSPFLALSTGC

SEQ ID NO: 5328-5329 - skipped (2 entries)

SEQ ID NO: 5330 - protein, 64 aa, Canis lupus familiaris
PHSGPSEKSKPVPASRAPAVPEPKPRLSPQHHPEAGLLAVHALAGRPGAVQRGFAGRAACAVPV

SEQ ID NO: 5331 - skipped

SEQ ID NO: 5332 - protein, 30 aa, Canis lupus familiaris
PHSQSPASKPWELGTSKGSQRMRRPGSAKG

SEQ ID NO: 5333 - protein, 10 aa, Canis lupus familiaris
PHSRQSEIHS

SEQ ID NO: 5334 - skipped

SEQ ID NO: 5335 - protein, 48 aa, Canis lupus familiaris
PHSRTAAKTTLWTCWARISGLPTPLIPSVVPPGTCSPKSWTSPSSTGS

SEQ ID NO: 5336 - protein, 47 aa, Canis lupus familiaris
PHSSALATGLHHHHRISLPPQGSLLHLLLQGQHLWPSLRLRLRPPQT

SEQ ID NO: 5337 - protein, 13 aa, Canis lupus familiaris
PHSSASAQMPPTP

SEQ ID NO: 5338 - protein, 86 aa, Canis lupus familiaris
PHTLAAPDPARRHSASVSGSSATRTPQVRGRRSGSCGSSPASGCDPTSARRSRSWRCWCRSSCWPSCLRRRGPGGFAAAPMCASRA

SEQ ID NO: 5339 - protein, 11 aa, Canis lupus familiaris
PHTLTAPPWTT

SEQ ID NO: 5340 - protein, 68 aa, Canis lupus familiaris
PHTPAQGTRTRARGRPNPVTAARALPSCSRVRTRLPGATGAHAPAAWTRVLARWERRRPLARASTSQT

SEQ ID NO: 5341 - protein, 37 aa, Canis lupus familiaris
PHTPHLCSRAPPLRTVGAPPHEGARTAQPGRWTDWGS

SEQ ID NO: 5342 - protein, 79 aa, Canis lupus familiaris
PHTRGGEDPVAVPLDVPEDALPLLPPHLLPLLPHLRHPVLEAGPAPHPPDGEVTGGGGTVLIVHMTITKGRGCCRRSVQ

SEQ ID NO: 5343 - protein, 74 aa, Canis lupus familiaris
PHTVPAWSTCMALLSRMAPATSVRRLSSPLHCPVTAKPQSPRPSSNESPWTHRHGPVTARVGCLECSPKVPWQH

SEQ ID NO: 5344 - protein, 31 aa, Canis lupus familiaris
PHWDATPAGEPSLQGREASVTTTVITSPARA

SEQ ID NO: 5345 - protein, 20 aa, Canis lupus familiaris
PHWKVNSAEISLPRFLFQLH

SEQ ID NO: 5346 - protein, 16 aa, Canis lupus familiaris
PHWLDCQRPASHGGCV

SEQ ID NO: 5347 - skipped

SEQ ID NO: 5348 - protein, 44 aa, Canis lupus familiaris
PIAGGRTPSSPWPLPCVRVKKVATVGSRCAEAERTLRLGTGVRP

SEQ ID NO: 5349 - protein, 12 aa, Canis lupus familiaris
PICHIWSPGIKA

SEQ ID NO: 5350 - skipped

SEQ ID NO: 5351 - protein, 14 aa, Canis lupus familiaris
PIIKARARGACLCP

SEQ ID NO: 5352 - skipped

SEQ ID NO: 5353 - protein, 31 aa, Canis lupus familiaris
PILSVSSSKMVTCMCNGRIHRIFIADAYLTK

SEQ ID NO: 5354 - protein, 23 aa, Canis lupus familiaris
PILTYLHVGHIPARPWGCWPQRS

SEQ ID NO: 5355 - protein, 17 aa, Canis lupus familiaris
PIPAEAQAAVLQEETQS

SEQ ID NO: 5356 - protein, 19 aa, Canis lupus familiaris
PIPCCMEVGRCQTQMPPRM

SEQ ID NO: 5357 - protein, 47 aa, Canis lupus familiaris
PIPLPHHRGLPEAGWRDHHALHRGPVLLYQYQRLVHEEMPRSEFSLH

SEQ ID NO: 5358 - protein, 24 aa, Canis lupus familiaris
PIPPATPTGPQSPSVDSNPWMLTA

SEQ ID NO: 5359 - protein, 18 aa, Canis lupus familiaris
PIPPCSPSPPSGSGGGVL

SEQ ID NO: 5360 - skipped

SEQ ID NO: 5361 - protein, 8 aa, Canis lupus familiaris
PIRSASGQ

SEQ ID NO: 5362 - protein, 19 aa, Canis lupus familiaris
PISNNCHPPSYRIPHIVLW

SEQ ID NO: 5363 - protein, 41 aa, Canis lupus familiaris
PISTWGGLRAGLWGGCGASSQVLRDGPGHGAPEVLPRDRHR

SEQ ID NO: 5364 - protein, 79 aa, Canis lupus familiaris
PISVVECLLQCEETENRALWLGCFWTEQQRQILYPQQNPPSHTRASQLLSPGSKFQHPCLRPGPPPPSSCSGAYCCNSC

SEQ ID NO: 5365 - skipped

SEQ ID NO: 5366 - protein, 41 aa, Canis lupus familiaris
PIWPTMTRGWSTLTGSWRCRILKNRISLTSWTMTSFSGLET

SEQ ID NO: 5367 - protein, 9 aa, Canis lupus familiaris
PIYLALFHR

SEQ ID NO: 5368 - protein, 21 aa, Canis lupus familiaris
PKAATWQKKLVSGRSVAARQA

SEQ ID NO: 5369 - protein, 16 aa, Canis lupus familiaris
PKAGRGAVGACVLHGL

SEQ ID NO: 5370 - skipped

SEQ ID NO: 5371 - protein, 13 aa, Canis lupus familiaris
PKAPVLAVSPPRS

SEQ ID NO: 5372 - protein, 10 aa, Canis lupus familiaris
PKASPEMTRL

SEQ ID NO: 5373 - protein, 40 aa, Canis lupus familiaris
PKCYCRRTKSHLPRPSPLCRCSSTCSSCRRCSPPHHYSLP

SEQ ID NO: 5374 - protein, 9 aa, Canis lupus familiaris
PKDSCPETG

SEQ ID NO: 5375 - protein, 26 aa, Canis lupus familiaris
PKEEEEETPVVGGTLQKDTAEKGRLL

SEQ ID NO: 5376 - protein, 29 aa, Canis lupus familiaris
PKEEGCAGAQGGAPRAPRAAAHQRGPREA

SEQ ID NO: 5377 - protein, 57 aa, Canis lupus familiaris
PKEGWTAALWGLPHPWRTASRLYRAKTAPLKTSNTSWLLLRGGAGGMGGHLSPKQQG

SEQ ID NO: 5378 - protein, 8 aa, Canis lupus familiaris
PKGPTTWL

SEQ ID NO: 5379 - protein, 37 aa, Canis lupus familiaris
PKHGRQCQRQQQLSLLPEPYLVPGHPQRRAVHQLVPL

SEQ ID NO: 5380 - skipped

SEQ ID NO: 5381 - protein, 33 aa, Canis lupus familiaris
PKHVPRLQPHPGELPSLPRPVMSHPRRAPWEKR

SEQ ID NO: 5382 - protein, 65 aa, Canis lupus familiaris
PKKSQVLSELSLGPQPSTRPGPMTAAAAVPAGCPSPSALQTSALWGPLPQPHLVLCRVQDPCSST

SEQ ID NO: 5383 - protein, 52 aa, Canis lupus familiaris
PKLDPTARLQVNIANRAAATGSRVHSDRTTPVAWVFMGRSLEDFPDQERTGA

SEQ ID NO: 5384 - protein, 15 aa, Canis lupus familiaris
PKLLACGLDSGAPVL

SEQ ID NO: 5385 - protein, 61 aa, Canis lupus familiaris
PKLPHESTGACSLPSKQSPPHPVPRPPRVSPSLPSLTLGPQPQPPPLRGRNQRPPLLPCTW

SEQ ID NO: 5386 - protein, 13 aa, Canis lupus familiaris
PKLRGHALVYSSR

SEQ ID NO: 5387 - skipped

SEQ ID NO: 5388 - protein, 24 aa, Canis lupus familiaris
PKNRVLGTNCPSPISLPRRLMWLK

SEQ ID NO: 5389 - protein, 11 aa, Canis lupus familiaris
PKPHTQPLTLQ

SEQ ID NO: 5390 - protein, 75 aa, Canis lupus familiaris
PKPQLTHLHLPLGECRTASQERKCGSGSSLRPRAKQPVPCPSSGQALESPLCCSRKKGHWREWGGHRGWTCPRGS

SEQ ID NO: 5391 - protein, 27 aa, Canis lupus familiaris
PKPSPPSCRSAGPQAAMQATRCMTAWS

SEQ ID NO: 5392 - skipped

SEQ ID NO: 5393 - protein, 14 aa, Canis lupus familiaris
PKQARQYLHWRRQL

SEQ ID NO: 5394 - skipped

SEQ ID NO: 5395 - protein, 43 aa, Canis lupus familiaris
PKRGRWAPTTPWNALKCWQPPALCPCPLEMLALSRTRPHSHFL

SEQ ID NO: 5396 - protein, 46 aa, Canis lupus familiaris
PKRGWCSGPSSFHGEWTGSSPGIPRETAWLPISSQHSGDWSRYNQG

SEQ ID NO: 5397 - skipped

SEQ ID NO: 5398 - protein, 72 aa, Canis lupus familiaris
PKSGAVPGAPPQCCPSSTHRTAATTQPGPRGCKHRQRCPAGPPGPSSHSVVRQCSSPRPFSPKCSHLIHPPV

SEQ ID NO: 5399 - protein, 24 aa, Canis lupus familiaris
PKSPRSWKTSGHCFQPLDRTFLQC

SEQ ID NO: 5400 - protein, 29 aa, Canis lupus familiaris
PKSQPPEPSPQQASTEAASSEAATTTERV

SEQ ID NO: 5401 - skipped

SEQ ID NO: 5402 - protein, 38 aa, Canis lupus familiaris
PKSRGCPSIAKASSNTMVLSPFPSFKPGPSLLDSLLGI

SEQ ID NO: 5403 - protein, 22 aa, Canis lupus familiaris
PKSRGVSAFLTNPTTALISGAS

SEQ ID NO: 5404 - protein, 12 aa, Canis lupus familiaris
PKTAAPRSLPVL

SEQ ID NO: 5405 - protein, 16 aa, Canis lupus familiaris
PKTGRAMRTTWSSWRS

SEQ ID NO: 5406 - protein, 62 aa, Canis lupus familiaris
PKTKGGAQRPRSPPWFRKGQLLPGQGPQCDSQQFSTHAYWREGKPDQLLPIRTPEGPQPPDQ

SEQ ID NO: 5407 - skipped

SEQ ID NO: 5408 - protein, 64 aa, Canis lupus familiaris
PKTPEVTLGSMEESGDHGIRRNTRKRSQAKIRLRKSRRKVRQRRNSRKQVRFQIAVQVFAITVD

SEQ ID NO: 5409 - protein, 13 aa, Canis lupus familiaris
PKTQTESKASEYS

SEQ ID NO: 5410 - protein, 15 aa, Canis lupus familiaris
PKTTGLWSGLRGPSS

SEQ ID NO: 5411 - protein, 9 aa, Canis lupus familiaris
PKTWSPSPL

SEQ ID NO: 5412-5413 - skipped (2 entries)

SEQ ID NO: 5414 - protein, 15 aa, Canis lupus familiaris
PKYHYPPSFLHCQEQ

SEQ ID NO: 5415 - protein, 27 aa, Canis lupus familiaris
PLAGERCLGCGAFCRGPANPKSQPAVS

SEQ ID NO: 5416 - protein, 16 aa, Canis lupus familiaris
PLAGPCCIWPPPPSLC

SEQ ID NO: 5417 - protein, 16 aa, Canis lupus familiaris
PLAGTCPQRRKPMKMC

SEQ ID NO: 5418 - protein, 24 aa, Canis lupus familiaris
PLAGWTRSCQMGCSSKTMTSPLNC

SEQ ID NO: 5419 - protein, 19 aa, Canis lupus familiaris
PLAHRNTLCYGKIPSNLRN

SEQ ID NO: 5420 - protein, 65 aa, Canis lupus familiaris
PLALTWTSHHPGPLTPPIPMKTLLMKLLTCQKASAMAHPLCTPRRGPHRPTDLACGCSLRPGVPQ

SEQ ID NO: 5421 - protein, 57 aa, Canis lupus familiaris
PLAPAAASRPATPPCRSSTPWRRCWRRSRPCASRCRPRSSASRPWRTCCASWWTAPT

SEQ ID NO: 5422 - skipped

SEQ ID NO: 5423 - protein, 72 aa, Canis lupus familiaris
PLAPPLPPRLPLSPLPPPVPPPRPRPLPPLPLRLLAPLPPSQPASLPAPRPPPPARQRPGRSTCPGSSSATS

SEQ ID NO: 5424 - skipped

SEQ ID NO: 5425 - protein, 42 aa, Canis lupus familiaris
PLATCLALHHRVPAYRCACPARPRPLAAAGRGEGHQCPAREP

SEQ ID NO: 5426 - protein, 15 aa, Canis lupus familiaris
PLCLYRVVPTRWILM

SEQ ID NO: 5427 - protein, 20 aa, Canis lupus familiaris
PLCMKQCLRPCSQLREFSTL

SEQ ID NO: 5428 - skipped

SEQ ID NO: 5429 - protein, 42 aa, Canis lupus familiaris
PLCVLCCCWQRARPSGSAGCRCWASCRGCCWTHGQGPVLCTP

SEQ ID NO: 5430 - protein, 44 aa, Canis lupus familiaris
PLCVTCTPCEPSSSSPGPSQREPPSLPGLRSSLTSLTRVLSRPT

SEQ ID NO: 5431 - protein, 25 aa, Canis lupus familiaris
PLEFGNASSPPTLLRPLSPLMGSAL

SEQ ID NO: 5432 - protein, 63 aa, Canis lupus familiaris
PLESGPRPGRSPPPPPPRRGPGDPGLAALLQVITPARTCSRVMSTFPQTLFFVCLVFCFFFFA

SEQ ID NO: 5433 - protein, 22 aa, Canis lupus familiaris
PLESPRNWVCSTWSSSQKRSSQ

SEQ ID NO: 5434 - protein, 54 aa, Canis lupus familiaris
PLETAPVLGLATAVHIYPQLVMPREGRSSLLGEQIRTGASQMCTPWIWEHTGGT

SEQ ID NO: 5435 - protein, 48 aa, Canis lupus familiaris
PLGACSMSLWGRQLRSWCWLPWCSWMELFSSVCSSHPGSSQRARRGHR

SEQ ID NO: 5436 - protein, 25 aa, Canis lupus familiaris
PLGAPRCPQSLPPAPAWPRPTPTCC

SEQ ID NO: 5437 - protein, 9 aa, Canis lupus familiaris
PLGEQTPTA

SEQ ID NO: 5438 - protein, 28 aa, Canis lupus familiaris
PLGLLSLKRTALHGSAPPPPVPPRTPST

SEQ ID NO: 5439 - protein, 49 aa, Canis lupus familiaris
PLGPPAAPRLPGACGRSCLSAVVTQSCTSLDSCGHQMPVPVPILAERLS

SEQ ID NO: 5440 - protein, 58 aa, Canis lupus familiaris
PLGPRRHRQPIPRGCQTSSTLRGRQPPDGDLRTPARDWQRPRWGRRRSRQHGQPPNRA

SEQ ID NO: 5441-5442 - skipped (2 entries)

SEQ ID NO: 5443 - protein, 19 aa, Canis lupus familiaris
PLGQLAPGMGWWQVAARNI

SEQ ID NO: 5444 - protein, 50 aa, Canis lupus familiaris
PLGRGRTSCHFTGHFLVLATHHLRAALPRPTALPLYLKSQPAHRPRFQAF

SEQ ID NO: 5445 - protein, 51 aa, Canis lupus familiaris
PLGRSQPSPRQRPKLAPPLQPVASVATPPWQGVVTKGRPRPWTARSRRQAS

SEQ ID NO: 5446 - protein, 50 aa, Canis lupus familiaris
PLGRSQPSPRQRPKLAPPLQPVASVATPPWQGVVTKGRPRPWTARSRRQI

SEQ ID NO: 5447 - protein, 26 aa, Canis lupus familiaris
PLGRWSGPASSRPRTRRAPTTRSSAS

SEQ ID NO: 5448 - protein, 16 aa, Canis lupus familiaris
PLHCMWGRASWACRRS

SEQ ID NO: 5449 - protein, 29 aa, Canis lupus familiaris
PLHHTAAGGCCLSVFQTRPGGCLPGGCGD

SEQ ID NO: 5450-5451 - skipped (2 entries)

SEQ ID NO: 5452 - protein, 14 aa, Canis lupus familiaris
PLHLPPPCPSRPHC

SEQ ID NO: 5453 - protein, 18 aa, Canis lupus familiaris
PLHNLGPHPWRARWPQVG

SEQ ID NO: 5454 - protein, 37 aa, Canis lupus familiaris
PLHPQQASAQRHQQRGSAAAGEGTQLQRQLDGGRRGH

SEQ ID NO: 5455 - protein, 41 aa, Canis lupus familiaris
PLHRGAVGGAPPVGAALLRPQIQSAFGAVGSCLAGVCPYVS

SEQ ID NO: 5456 - protein, 72 aa, Canis lupus familiaris
PLHSAPSPDMPRTQALLLAAPSLGDSPASAASASGGPASPGAACSLHPPPSPSAKPARPPSSSRIHRLDRPT

SEQ ID NO: 5457 - skipped

SEQ ID NO: 5458 - protein, 9 aa, Canis lupus familiaris
PLIQFLTFE

SEQ ID NO: 5459 - protein, 15 aa, Canis lupus familiaris
PLITLRYSLAVLILF

SEQ ID NO: 5460 - protein, 32 aa, Canis lupus familiaris
PLKLPSQVTCLGKESTLLTCLLRAPITASLLA

SEQ ID NO: 5461 - protein, 19 aa, Canis lupus familiaris
PLKPAAPRGPIRAKTASIF

SEQ ID NO: 5462 - protein, 29 aa, Canis lupus familiaris
PLKPLLHSPPKKPHLRTSPPLPRSPLGFS

SEQ ID NO: 5463 - protein, 11 aa, Canis lupus familiaris
PLKPPASVLHH

SEQ ID NO: 5464 - protein, 16 aa, Canis lupus familiaris
PLKTLNVSARAPRPFW

SEQ ID NO: 5465 - protein, 24 aa, Canis lupus familiaris
PLKVWSLQGPWMCWAPAIKGENGP

SEQ ID NO: 5466 - protein, 49 aa, Canis lupus familiaris
PLLCPPPLRWQPLQTPRVVGWRQSWSTCDRPWRAAWTPRKPKRSSCTRW

SEQ ID NO: 5467 - protein, 57 aa, Canis lupus familiaris
PLLDTQRARVGTPGTRHAEHLPLPAPGAGLPTARWESRRFWWPGRGPRSQGSPMLLQ

SEQ ID NO: 5468 - protein, 37 aa, Canis lupus familiaris
PLLERGHLPWSLPWRGLSLGMEQSLRSTGAAPPPQWS

SEQ ID NO: 5469 - protein, 89 aa, Canis lupus familiaris
PLLGQAGLQNLDLPHPQDCPRLPPLRSPATTCSLTPRVSPTRCWWTRSLRGSPGQTGLQPRKSVTAAPCAPGSSSTCPTCSDTASPTRR

SEQ ID NO: 5470 - protein, 20 aa, Canis lupus familiaris
PLLGWERSLGITLRAKFFGL

SEQ ID NO: 5471 - protein, 20 aa, Canis lupus familiaris
PLLISLTGCQAMRQETTFSL

SEQ ID NO: 5472 - protein, 17 aa, Canis lupus familiaris
PLLLPLPVQWPPEPQPV

SEQ ID NO: 5473 - protein, 17 aa, Canis lupus familiaris
PLLLPVRGKLIKSCKMN

SEQ ID NO: 5474 - protein, 76 aa, Canis lupus familiaris
PLLPGRAPGSGETLHRSPQQPDRRVQGEILPSEEHDRAGAAAAHRRSLPVRQTRVPTAAGLRHGPRLARRPRHLAQ

SEQ ID NO: 5475 - protein, 58 aa, Canis lupus familiaris
PLLPSRSAHLFTSISTCSSTSHSPCSSPLGTSSPCRSSLPYTHRPCSRDLLFNPTIRL

SEQ ID NO: 5476 - protein, 25 aa, Canis lupus familiaris
PLLRLTWIMWFLKSTDICRRSSGAV

SEQ ID NO: 5477 - protein, 35 aa, Canis lupus familiaris
PLLVPAPAHEEPAPPQTAWASQRTLAWAPGMKMAN

SEQ ID NO: 5478 - skipped

SEQ ID NO: 5479 - protein, 31 aa, Canis lupus familiaris
PLNLMQTIHSSSSSGTTKLLAFSFMGDSAPP

SEQ ID NO: 5480 - skipped

SEQ ID NO: 5481 - protein, 56 aa, Canis lupus familiaris
PLPANAAFGPGPVPGCPWDPAPSPGGPGVRGRAAPKGQACRTPRSDVGARAPAART

SEQ ID NO: 5482 - protein, 49 aa, Canis lupus familiaris
PLPAPGIRTINPVPWRSMLTASWHWLQSSGPSLITPLPSPSSTYTGKVT

SEQ ID NO: 5483 - protein, 31 aa, Canis lupus familiaris
PLPAPGRPPRLTAGLPAPVSPRLAGGGATRG

SEQ ID NO: 5484 - protein, 40 aa, Canis lupus familiaris
PLPATTLTGGIFEPSIRGSVLQLPEMKPTLTPELSFTSQM

SEQ ID NO: 5485 - protein, 22 aa, Canis lupus familiaris
PLPCAESARPCGHTCLPACGPT

SEQ ID NO: 5486 - protein, 30 aa, Canis lupus familiaris
PLPEGAALARESPERGPLGPACRRAAGQAF

SEQ ID NO: 5487 - protein, 19 aa, Canis lupus familiaris
PLPGPPAWRDPGACPPPPV

SEQ ID NO: 5488 - protein, 94 aa, Canis lupus familiaris
PLPGRQPLGHRVLLVGRRRRRALHQPVPRPQAQPPAGGIPLVLEGAPPGRVRVPVARGRPPPRAPRGEAFESGRQEQTARRVHHVPRGGDGPRV

SEQ ID NO: 5489 - protein, 11 aa, Canis lupus familiaris
PLPHCLAHSLM

SEQ ID NO: 5490 - protein, 28 aa, Canis lupus familiaris
PLPHIDPWSLPPPPPRAPQPPEFARGPS

SEQ ID NO: 5491 - protein, 17 aa, Canis lupus familiaris
PLPILTLPCSQDSSMRT

SEQ ID NO: 5492 - protein, 61 aa, Canis lupus familiaris
PLPLSPPPPPPAWAPSARATGPAPTPPTASCASCRPSPGCPAPPSAKCATGCAPWRASAAP

SEQ ID NO: 5493 - protein, 13 aa, Canis lupus familiaris
PLPNTPALMPWIS

SEQ ID NO: 5494 - skipped

SEQ ID NO: 5495 - protein, 23 aa, Canis lupus familiaris
PLPPHPAQWTAHCAHTSERQLLP

SEQ ID NO: 5496 - protein, 12 aa, Canis lupus familiaris
PLPPPLEPMTWS

SEQ ID NO: 5497 - protein, 36 aa, Canis lupus familiaris
PLPPPPPFHTQPQRTGLTPKADLCGSRETIPRQRIL

SEQ ID NO: 5498 - protein, 9 aa, Canis lupus familiaris
PLPPQDRSA

SEQ ID NO: 5499 - protein, 37 aa, Canis lupus familiaris
PLPPRLGREAPRRPLQTSPVTGDCSRPRPRWMRWWTS

SEQ ID NO: 5500 - protein, 13 aa, Canis lupus familiaris
PLPPRPPKPGKGR

SEQ ID NO: 5501 - protein, 65 aa, Canis lupus familiaris
PLPQPMLSMHCPSLTCMKCSRWLMVPALCFPQLASCCPTTTLLPQATAVQGAWVGSILSLFRQIG

SEQ ID NO: 5502 - protein, 43 aa, Canis lupus familiaris
PLPRAAAPGSRRVGPRPRAPRGPPRPSRPPRPVRSQGLTMLPT

SEQ ID NO: 5503 - protein, 31 aa, Canis lupus familiaris
PLPRRSRPGFSPRGRERRGMILLITSPMTST

SEQ ID NO: 5504 - protein, 18 aa, Canis lupus familiaris
PLPSAVKVHRLMQPPLAL

SEQ ID NO: 5505 - protein, 18 aa, Canis lupus familiaris
PLPSHPLSLPGPQGLTGC

SEQ ID NO: 5506 - protein, 22 aa, Canis lupus familiaris
PLPSPHSHHTPSMCPGRSPRRM

SEQ ID NO: 5507 - protein, 17 aa, Canis lupus familiaris
PLPTLRGNKSTAYFPWV

SEQ ID NO: 5508 - protein, 30 aa, Canis lupus familiaris
PLPTPPPLRRPTPPPPRAAQRTVPRGTRLN

SEQ ID NO: 5509 - protein, 55 aa, Canis lupus familiaris
PLPTRPHLSGSSPSAAPTFSPLGKGVTQTKRRKAWKAERTASGAVEPSQLNRACC

SEQ ID NO: 5510 - protein, 11 aa, Canis lupus familiaris
PLPVTARRMPP

SEQ ID NO: 5511 - protein, 11 aa, Canis lupus familiaris
PLQCSVTTDCP

SEQ ID NO: 5512 - protein, 53 aa, Canis lupus familiaris
PLQDHLQTPGLPGHRSGHGGTAEDCQELAPRNHSPVRENTDRGDAQDMPLTPT

SEQ ID NO: 5513 - protein, 15 aa, Canis lupus familiaris
PLQEAAFQVLQVEVL

SEQ ID NO: 5514 - protein, 94 aa, Canis lupus familiaris
PLQKPCLQIWTLLWPSIHPCPHHHLHTTPQPPQSITNSKQAGNKDLPASTLHAHSLIPVIIHCFTPEQPLKLVPLQSTCQVLKQQHLIAPTPQD

SEQ ID NO: 5515 - protein, 41 aa, Canis lupus familiaris
PLQLQSWRTLHPAISQRHSHPSSLEVPSGHCLPHSILTSFK

SEQ ID NO: 5516 - protein, 11 aa, Canis lupus familiaris
PLQLSATSRPR

SEQ ID NO: 5517 - protein, 15 aa, Canis lupus familiaris
PLQPDLRGTSRSLWP

SEQ ID NO: 5518 - protein, 15 aa, Canis lupus familiaris
PLQPRQSARRRHSHP

SEQ ID NO: 5519 - protein, 28 aa, Canis lupus familiaris
PLQWTITSGLPDPRNPTRTWRQMKRRRS

SEQ ID NO: 5520 - protein, 67 aa, Canis lupus familiaris
PLRAPLAHSLHHRSPRPARGSMPLPRWNRTRGGRPVLRDQTLPMRLPPLQPGPQVLGARKGRTEQGP

SEQ ID NO: 5521 - protein, 82 aa, Canis lupus familiaris
PLRAPLAHSLHHRSPRPARGSMPLPRWNRTRGGRPVLRDQTLPMRLPPLQPGPQVLGARKGRTEQVRGWGCKLTILSATSAA

SEQ ID NO: 5522 - protein, 14 aa, Canis lupus familiaris
PLRAPTLLLLSTRA

SEQ ID NO: 5523 - skipped

SEQ ID NO: 5524 - protein, 33 aa, Canis lupus familiaris
PLRCPFQPETGISRAQSVRSARGTASRWGMWRH

SEQ ID NO: 5525 - protein, 8 aa, Canis lupus familiaris
PLRCRNPW

SEQ ID NO: 5526 - protein, 10 aa, Canis lupus familiaris
PLRPGRRPPS

SEQ ID NO: 5527 - protein, 64 aa, Canis lupus familiaris
PLRPPRPARSSPPRRCSPGTGRSRQPVTGRSARSSPLGTGTRTPTAPRTTRSATRAWTSTSPAG

SEQ ID NO: 5528 - protein, 23 aa, Canis lupus familiaris
PLRRRGLRGTAGRTRGEPREHPG

SEQ ID NO: 5529 - protein, 15 aa, Canis lupus familiaris
PLRSCEHHHQPGCSI

SEQ ID NO: 5530 - protein, 28 aa, Canis lupus familiaris
PLRSLWTLPHSCSNLSKRKTMGSVGSIA

SEQ ID NO: 5531 - protein, 24 aa, Canis lupus familiaris
PLRSQYHQVWKEPGEPFSGPGALM

SEQ ID NO: 5532 - protein, 77 aa, Canis lupus familiaris
PLRTEMNCWPHPWREPFPLIWAFPWMPQRTSRPLPPSSPQSPATWSHWMRAPSARSSRRNPSSGHIRRPQSRASPAV

SEQ ID NO: 5533 - protein, 9 aa, Canis lupus familiaris
PLRVLPVNS

SEQ ID NO: 5534 - protein, 61 aa, Canis lupus familiaris
PLRWRRASPPASGLPVRAHQPRRPSAPAALAPCSPPGRPASWGRCRARRSATRADPGPPAP

SEQ ID NO: 5535 - protein, 10 aa, Canis lupus familiaris
PLRWSLRSLF

SEQ ID NO: 5536 - protein, 20 aa, Canis lupus familiaris
PLSGASLPPSSSCRWNPLQP

SEQ ID NO: 5537 - protein, 19 aa, Canis lupus familiaris
PLSGSNHRPPTWRKGRLWI

SEQ ID NO: 5538 - protein, 9 aa, Canis lupus familiaris
PLSILLSME

SEQ ID NO: 5539 - skipped

SEQ ID NO: 5540 - protein, 36 aa, Canis lupus familiaris
PLSLQRKTLYPALWEPHLHLSQALPTPLCSPLPGLP

SEQ ID NO: 5541 - protein, 11 aa, Canis lupus familiaris
PLSMVGPSVPT

SEQ ID NO: 5542 - protein, 13 aa, Canis lupus familiaris
PLSPRGARARRAR

SEQ ID NO: 5543 - protein, 54 aa, Canis lupus familiaris
PLSPRRLSLLPPLCQPLLQTSHRSLFPRPPPHLLPRRPSSLWSLPHRLSSRKRV

SEQ ID NO: 5544 - protein, 12 aa, Canis lupus familiaris
PLSQLVICSGAE

SEQ ID NO: 5545 - protein, 14 aa, Canis lupus familiaris
PLSRETPPSHSPPV

SEQ ID NO: 5546 - protein, 11 aa, Canis lupus familiaris
PLSRWKGKSTP

SEQ ID NO: 5547 - protein, 22 aa, Canis lupus familiaris
PLSSCQQPSPLSPPTPRMGLML

SEQ ID NO: 5548 - protein, 17 aa, Canis lupus familiaris
PLSSPPPLQVWLQLPPW

SEQ ID NO: 5549 - protein, 62 aa, Canis lupus familiaris
PLSVSTVCCLTSSSSRKGEFIEEKDQSFCWKMLFPVATLPPPGAPTTTWPASLTSRWMKFRA

SEQ ID NO: 5550 - protein, 57 aa, Canis lupus familiaris
PLSWGLLLLRLFTSSLHHFLPRHLDGPPLQNLPFRVPGSLQTIKHPSPWPPQPCWAV

SEQ ID NO: 5551 - protein, 39 aa, Canis lupus familiaris
PLTACLTQLCKYYPGGAMGSRDAKSRSTITISGAPVCQE

SEQ ID NO: 5552 - skipped

SEQ ID NO: 5553 - protein, 21 aa, Canis lupus familiaris
PLTCSGSSRRLCRKAPSSAAP

SEQ ID NO: 5554 - protein, 32 aa, Canis lupus familiaris
PLTHLPPTSYGNWTDSSSLLLSHVLPEGQRCC

SEQ ID NO: 5555 - protein, 55 aa, Canis lupus familiaris
PLTISSQIGTPGLRARNFFRRKKFLRIWNPRKKYQKTIPVIFPRCLSLENSVMMY

SEQ ID NO: 5556 - protein, 21 aa, Canis lupus familiaris
PLTPHRPLEPPPATAACPSAP

SEQ ID NO: 5557 - protein, 73 aa, Canis lupus familiaris
PLTQASCGPSAQPSTSSGIKRSSRASGQTPCSSGSWCPSRCLRPRPRIHIPPTPTPWTMQISILSSLRPVAPF

SEQ ID NO: 5558 - skipped

SEQ ID NO: 5559 - protein, 18 aa, Canis lupus familiaris
PLTSVHPHPPMSLLGDLV

SEQ ID NO: 5560 - protein, 87 aa, Canis lupus familiaris
PLTWPVSAVVPHQVQGCHGASSAPRAPGRGSPESLERRAGPGARRPATTCGSGCAPAVPWAAQVARSSRCPPTRRRPRCWAPRTWTT

SEQ ID NO: 5561 - protein, 20 aa, Canis lupus familiaris
PLTWTSRPSMTKVCLERLRN

SEQ ID NO: 5562 - protein, 11 aa, Canis lupus familiaris
PLVATGHLLRS

SEQ ID NO: 5563 - protein, 43 aa, Canis lupus familiaris
PLVLKILPFRVWIQEMRLFPVQERLLLLQTKRVSALQQRLPQL

SEQ ID NO: 5564 - protein, 20 aa, Canis lupus familiaris
PLVQTHKARSWSTFVRSRLT

SEQ ID NO: 5565 - protein, 36 aa, Canis lupus familiaris
PLWGTAGSQPQEPRPPGRGGGAPLLGPPACTQNPGC

SEQ ID NO: 5566 - protein, 12 aa, Canis lupus familiaris
PLWPTGTENKKS

SEQ ID NO: 5567 - protein, 8 aa, Canis lupus familiaris
PLWYPYHP

SEQ ID NO: 5568 - protein, 30 aa, Canis lupus familiaris
PLYLCGSFHCTLSCGAKDMLSPGPQLSGLS

SEQ ID NO: 5569 - protein, 26 aa, Canis lupus familiaris
PLYTSSCVHWSSRCSPGFFTPPPHPV

SEQ ID NO: 5570 - protein, 12 aa, Canis lupus familiaris
PMAPMLTPTSSS

SEQ ID NO: 5571 - protein, 57 aa, Canis lupus familiaris
PMEGSSTRWSLCSKTEARSSGTWPSPLISATCTSCLRDRSPGSPWNPANSTRPVGNV

SEQ ID NO: 5572 - protein, 9 aa, Canis lupus familiaris
PMEKDFQRW

SEQ ID NO: 5573 - protein, 9 aa, Canis lupus familiaris
PMEPCTGQT

SEQ ID NO: 5574 - protein, 35 aa, Canis lupus familiaris
PMPITKAIPLGARSWPGWRTWPPLQPAGCAVPTLR

SEQ ID NO: 5575 - protein, 24 aa, Canis lupus familiaris
PMPMGLRKARTEGQPTRCLPSQLS

SEQ ID NO: 5576 - protein, 36 aa, Canis lupus familiaris
PMPRGGGHDEEPKQPVLRGPTREALRAPGGQDPLQG

SEQ ID NO: 5577 - protein, 18 aa, Canis lupus familiaris
PMPRLCLRWSCSSSGERT

SEQ ID NO: 5578 - skipped

SEQ ID NO: 5579 - protein, 17 aa, Canis lupus familiaris
PMPSPRESPPRTGTLSS

SEQ ID NO: 5580 - protein, 29 aa, Canis lupus familiaris
PMQRKNPGPHNQRKSLTHPPCRKMPKLLP

SEQ ID NO: 5581 - protein, 22 aa, Canis lupus familiaris
PMRLMGYLSLEMVASLRRSCGA

SEQ ID NO: 5582 - protein, 41 aa, Canis lupus familiaris
PMRQAAGRRRRGAPWPRRRRARRRRPPGCASRASRSRRTRS

SEQ ID NO: 5583 - protein, 13 aa, Canis lupus familiaris
PMSLPPPHHGPGV

SEQ ID NO: 5584 - skipped

SEQ ID NO: 5585 - protein, 16 aa, Canis lupus familiaris
PMTPGTLCSTTSSAPR

SEQ ID NO: 5586 - protein, 95 aa, Canis lupus familiaris
PMVEDSMAVGYPQVVAMEGVLPPEGLMDHQLVGDPMGGSPLELQEDYMVVRPRGAPMVSHLQIPTVPSILGLMDRDLLQVSQWTPITVATSPSRS

SEQ ID NO: 5587 - protein, 10 aa, Canis lupus familiaris
PNEVSIFVLW

SEQ ID NO: 5588-5589 - skipped (2 entries)

SEQ ID NO: 5590 - protein, 22 aa, Canis lupus familiaris
PNHLLWGAQAGKHSLLPTCRHF

SEQ ID NO: 5591 - protein, 41 aa, Canis lupus familiaris
PNHTPAAKAHQAEASADTTPAQPQGLSAAAQLPHTHPEQVP

SEQ ID NO: 5592 - protein, 9 aa, Canis lupus familiaris
PNLHPTLSH

SEQ ID NO: 5593 - protein, 31 aa, Canis lupus familiaris
PNMASRANAGLGQIRVPVREHLLQRGPRVLA

SEQ ID NO: 5594 - protein, 69 aa, Canis lupus familiaris
PNMEAGQAWAGQPTAGRTVAGSSLEEELGAVAGEAGAEGPLIFLELEIPQWLTANLRSGRSGGGRTSRR

SEQ ID NO: 5595 - protein, 14 aa, Canis lupus familiaris
PNPCWLSGCLYVKL

SEQ ID NO: 5596 - protein, 19 aa, Canis lupus familiaris
PNPDALVVPHHQPHHHPRS

SEQ ID NO: 5597 - protein, 26 aa, Canis lupus familiaris
PNPPSGSCRETIPSYADRPQLVQLFL

SEQ ID NO: 5598 - protein, 41 aa, Canis lupus familiaris
PNPPSRPPRTWRAITSARRARCSPWATPPRRPRARSSTVAA

SEQ ID NO: 5599 - protein, 43 aa, Canis lupus familiaris
PNPSSSSSSHRCSRRRPQLSHHPHHSSHRNSSNSNARTKTARR

SEQ ID NO: 5600 - protein, 54 aa, Canis lupus familiaris
PNPVAPSLPTTGIYRWGPPSPGPLPLPHPTAPGTAQTGQTAQLPGTRLQESQPL

SEQ ID NO: 5601 - protein, 10 aa, Canis lupus familiaris
PNPVPMEAPA

SEQ ID NO: 5602 - protein, 23 aa, Canis lupus familiaris
PNSGPETANPVQRMAGRHGVRSV

SEQ ID NO: 5603 - protein, 87 aa, Canis lupus familiaris
PNSGRRTEAWRAGRGPGEPVGPASLLRAAGPSTWTAPSTGPGPAAAGAAGASKRGQVPGPAPMSQRGRRRSGVGSAGQRRQTQGRRR

SEQ ID NO: 5604 - protein, 29 aa, Canis lupus familiaris
PNSHPLWPSRRLRRALLHRAARPSSSRLT

SEQ ID NO: 5605 - protein, 12 aa, Canis lupus familiaris
PNSKHHGGDTHH

SEQ ID NO: 5606 - protein, 28 aa, Canis lupus familiaris
PNSPTKAQGPAACPASRAHPTQCPGHPE

SEQ ID NO: 5607 - skipped

SEQ ID NO: 5608 - protein, 43 aa, Canis lupus familiaris
PNSSAPALPYSPSECWTPTTTCPPSTNPSTLCPCPRTRHPARS

SEQ ID NO: 5609 - protein, 71 aa, Canis lupus familiaris
PNTPASSYLTAASPSPPPVRPKSCRTHPSTVTMTVAWRSLRRHPASHPRDPDSVRWLCLRITMNAPPLMAA

SEQ ID NO: 5610 - protein, 30 aa, Canis lupus familiaris
PNTRDSSFQTGVGDKAEWSSDDEKECSGPI

SEQ ID NO: 5611 - protein, 8 aa, Canis lupus familiaris
PNTSSMKI

SEQ ID NO: 5612 - skipped

SEQ ID NO: 5613 - protein, 12 aa, Canis lupus familiaris
PNWILQPGSKSI

SEQ ID NO: 5614 - protein, 23 aa, Canis lupus familiaris
PPAAAVAAPPAAPARASAGAVAL

SEQ ID NO: 5615 - protein, 24 aa, Canis lupus familiaris
PPAANCCARAASAVAPWLDLPGGL

SEQ ID NO: 5616 - protein, 76 aa, Canis lupus familiaris
PPAAPGLRRHLSLHLIPAPLGPSQQYCSQSRPAPTPSKKTRLLPAQPLERTKLLPGICRDSCWHPRCLSGPERKTV

SEQ ID NO: 5617 - protein, 50 aa, Canis lupus familiaris
PPAAPRGSGHLWGWIPPPPRPGHCCYRGSDPSSSREYRPHCRTGWSALQP

SEQ ID NO: 5618 - protein, 32 aa, Canis lupus familiaris
PPAATTSPCTSRLSLPPRASPRPPSATPSPFP

SEQ ID NO: 5619 - protein, 23 aa, Canis lupus familiaris
PPAAVALDEVRTTTCKDSTRTDA

SEQ ID NO: 5620 - protein, 23 aa, Canis lupus familiaris
PPAGRPSPPRRSSCGRNPGTMAR

SEQ ID NO: 5621 - protein, 52 aa, Canis lupus familiaris
PPAGTASPGTGPPRGRMRRPPRGARSEKRPRAPPRPALPGAASRRPPRPCAP

SEQ ID NO: 5622 - skipped

SEQ ID NO: 5623 - protein, 68 aa, Canis lupus familiaris
PPAPGLRPRRAQTPLASWLYARCPCPGCCPCPTTATCSGPWRPPRPHTPAHCGKWTQRRAQAQPPPAR

SEQ ID NO: 5624 - protein, 70 aa, Canis lupus familiaris
PPAPGLRPRRAQTPLASWLYARCPCPGCCPCPTTATCSGPWRPPRPHTPAHCGKWTQRRAQAQPPPVQAR

SEQ ID NO: 5625 - protein, 69 aa, Canis lupus familiaris
PPAPHPGVVVPCYSSRCRQGTFPGSLAPGLRPGEPAGQGVTPPRVEGASFPEVTGAGGCRLVQATAHFP

SEQ ID NO: 5626 - protein, 70 aa, Canis lupus familiaris
PPAPRGPGSAPSCPRAPSCARAKAASCWPSRASRSSPLSAMWHPRHPPSWQRLCWSSSWPSTSYSLMPCS

SEQ ID NO: 5627 - protein, 54 aa, Canis lupus familiaris
PPAPTTCPVLAHTASPESSAARSDAAERGSPGPGSPAGPAAQRHGGRHPHGSHL

SEQ ID NO: 5628 - skipped

SEQ ID NO: 5629 - protein, 10 aa, Canis lupus familiaris
PPASSPCEGQ

SEQ ID NO: 5630 - protein, 23 aa, Canis lupus familiaris
PPASSSPSTTRPAPPCSEPSAAY

SEQ ID NO: 5631 - protein, 81 aa, Canis lupus familiaris
PPASWAASATTSAPSTSARTWSRWARRRPRRRPQPRTPSRRPRPRPPPRPPPPGSTTTSSPTSSPTTTEARTARRRPSTAT

SEQ ID NO: 5632 - protein, 48 aa, Canis lupus familiaris
PPAVDSAARSQEAGGGRGARFSPPASPTRAAAGGGGRAGVGVPSASRG

SEQ ID NO: 5633 - protein, 37 aa, Canis lupus familiaris
PPCCLEPHSQLSPGAGALGLLPPRTLWGLGLLITPPR

SEQ ID NO: 5634 - protein, 13 aa, Canis lupus familiaris
PPCCPSRTASACP

SEQ ID NO: 5635 - protein, 51 aa, Canis lupus familiaris
PPCIWIFCGIRVRRQSPFDWTCGCHRRSETEESVPDGGCLFPRRRCEPSLI

SEQ ID NO: 5636 - protein, 64 aa, Canis lupus familiaris
PPCRPPPRPLQPPAPHVAAPAAPWRGWKPSCTSSGRRWLTSEPQMSGSCASCLLSMRALSPSSG

SEQ ID NO: 5637 - skipped

SEQ ID NO: 5638 - protein, 11 aa, Canis lupus familiaris
PPDRAATQHRR

SEQ ID NO: 5639 - protein, 19 aa, Canis lupus familiaris
PPDRWGSCLPGMTPSPGSR

SEQ ID NO: 5640 - protein, 70 aa, Canis lupus familiaris
PPFILPIPCQGPGPATLKAWSLRPWSGPASPAPCGRGRPEEATSCWLRRRQTHRRPSSRWWRTWRCTSPA

SEQ ID NO: 5641 - protein, 88 aa, Canis lupus familiaris
PPGAGRRRGRRGNRLRVRGVPSTQLLSKPGRDVRLHGSVRPGPAPAVRGVGARGRLAAQSRGQLLLRGTGVLGLASTRQPAVGGDSEH

SEQ ID NO: 5642 - protein, 66 aa, Canis lupus familiaris
PPGARARGRGRGGAGGARPARGPAAAGRADTLQPRRVAVLQLRGRLPAAGSRLRRGGRSVLPALAS

SEQ ID NO: 5643 - protein, 32 aa, Canis lupus familiaris
PPGEWLLQPRRADGVPAPGQRHLLQAGPGLPA

SEQ ID NO: 5644 - protein, 31 aa, Canis lupus familiaris
PPGLPPVPGHPVLARPGPLPEPDLLSAVHPL

SEQ ID NO: 5645 - protein, 75 aa, Canis lupus familiaris
PPGLRSGPRAPGRPAPPRPRARTAGTAAQRGRARRAAPAPTRSRGAPAARPPSPARAPRRRGPAAPAARRRPRKP

SEQ ID NO: 5646 - protein, 44 aa, Canis lupus familiaris
PPGPGSTPNSTRTCTRTRTRTRTHTRTRTWRARSTSTSTSTTSA

SEQ ID NO: 5647 - protein, 29 aa, Canis lupus familiaris
PPGPLPQALSEEECPQGDSNGLVGVASAG

SEQ ID NO: 5648 - skipped

SEQ ID NO: 5649 - protein, 31 aa, Canis lupus familiaris
PPGRAAGLPPLGSRGDALGCRHQLPSPLYVP

SEQ ID NO: 5650 - protein, 24 aa, Canis lupus familiaris
PPGTAHARCAPSSGCSSESSVRMN

SEQ ID NO: 5651 - protein, 10 aa, Canis lupus familiaris
PPGWGLAAAP

SEQ ID NO: 5652 - protein, 23 aa, Canis lupus familiaris
PPHAALRLLLPHHGCAQFADESQ

SEQ ID NO: 5653 - protein, 82 aa, Canis lupus familiaris
PPHGPCFPPGPLPAHLTRPSPTPSPRTHAHPHAGTPAPGAHQSLPRGTTRCPLGQPVPSPRPAAPLLRETATAPDVAGTTGG

SEQ ID NO: 5654 - skipped

SEQ ID NO: 5655 - protein, 17 aa, Canis lupus familiaris
PPHLPVLGASDPASLLR

SEQ ID NO: 5656 - protein, 42 aa, Canis lupus familiaris
PPHMPRGETGSDGSNQALLSVLIALDLQPLQGLPESFWSCWG

SEQ ID NO: 5657 - skipped

SEQ ID NO: 5658 - protein, 39 aa, Canis lupus familiaris
PPHPSPQGTQLRASCAHSVYHRARYISGFPYYPSGQGVL

SEQ ID NO: 5659 - protein, 30 aa, Canis lupus familiaris
PPIPPTTTAPSRPRWGTPISSPKTARSGPT

SEQ ID NO: 5660 - protein, 20 aa, Canis lupus familiaris
PPKCCRPSSPCTPCQAWPRS

SEQ ID NO: 5661 - protein, 60 aa, Canis lupus familiaris
PPKHTASAGARRGPAGPPASGAEAPAAAVPRPAAPSGSPACAGAPLVPGPLPAPLSLQQQ

SEQ ID NO: 5662 - protein, 17 aa, Canis lupus familiaris
PPKPPARSPPAQPGVCP

SEQ ID NO: 5663 - protein, 29 aa, Canis lupus familiaris
PPKTCWWPSAAGCGSAGPSPTTGRRPASC

SEQ ID NO: 5664 - skipped

SEQ ID NO: 5665 - protein, 32 aa, Canis lupus familiaris
PPLCLRLTRKPGRRVSLPPSPLWLWRSKWRRC

SEQ ID NO: 5666 - protein, 16 aa, Canis lupus familiaris
PPLEGVHPEEAPQSSS

SEQ ID NO: 5667 - skipped

SEQ ID NO: 5668 - protein, 31 aa, Canis lupus familiaris
PPLGCSAILPHLCPRPSWPTSWRSPSCPHGT

SEQ ID NO: 5669 - protein, 78 aa, Canis lupus familiaris
PPLGGGVGQREPWQERRASPSAPAPAAAGVWASAPPSPPLPSPPQFYRNTTRPGQMSESPSTGPGRENRLHYSVLFRL

SEQ ID NO: 5670 - protein, 22 aa, Canis lupus familiaris
PPLGSRKPRPLGTGCPQPGRQP

SEQ ID NO: 5671 - protein, 35 aa, Canis lupus familiaris
PPLLLPLHRLHPYHQAPNSRSQQHERLCQLPLRGQ

SEQ ID NO: 5672 - protein, 34 aa, Canis lupus familiaris
PPLNCCTVLDHLSQPITGLLPTPSSGPSGPPWTT

SEQ ID NO: 5673 - protein, 11 aa, Canis lupus familiaris
PPLPRAGAGEV

SEQ ID NO: 5674 - protein, 17 aa, Canis lupus familiaris
PPLPTCTATELSLPKTE

SEQ ID NO: 5675 - protein, 68 aa, Canis lupus familiaris
PPLRGQRGERGGEESPASQEHFGLQEAVGCVEALLPVAPGQLQGRVHPLHERVQQGQERQGPGHQLPD

SEQ ID NO: 5676 - protein, 16 aa, Canis lupus familiaris
PPLSFSLPKTKRGKTG

SEQ ID NO: 5677 - protein, 46 aa, Canis lupus familiaris
PPLSGQPHQPIPHSRQARGSRGGGRRGRSEPRVPPRAQRRGRAAGI

SEQ ID NO: 5678 - protein, 38 aa, Canis lupus familiaris
PPLTLSSKGHSAPCRSQSPFPSVLLATGSGRGQPPEGR

SEQ ID NO: 5679 - protein, 12 aa, Canis lupus familiaris
PPLVCTRCLALK

SEQ ID NO: 5680 - protein, 23 aa, Canis lupus familiaris
PPMPCSACTAWRPEASGALPSTP

SEQ ID NO: 5681 - protein, 91 aa, Canis lupus familiaris
PPPAAGARGLCPPRPGACAAGLPGLVCGGRGAGGGPRQRGRGRPARDPRGRGWAGVRAPQGARGCAWTGPRARRGQLPGPGAPARRPRRRR

SEQ ID NO: 5682 - protein, 91 aa, Canis lupus familiaris
PPPAPRPPPPNSFPVREGGGSLERGQRPLECGGQRRPCPGPRPTRHTGCPAAPGWGLGLCGRVPATEVKLGHYSVENGQAPRSPGRGQRER

SEQ ID NO: 5683 - skipped

SEQ ID NO: 5684 - protein, 49 aa, Canis lupus familiaris
PPPARRRLPGGIGGPAAGHPPAHQPHRGPPSRRHAAPRLCGHGAPAGGL

SEQ ID NO: 5685 - protein, 54 aa, Canis lupus familiaris
PPPCPLSGPGLSLQPSEASRRRHPRLRGARGTGRDVRARGKAAGLPASERRRPC

SEQ ID NO: 5686 - protein, 19 aa, Canis lupus familiaris
PPPCSFRLVSLDLEFKHST

SEQ ID NO: 5687 - protein, 30 aa, Canis lupus familiaris
PPPELCVPGPRAALELKICVTDLGPPGPPL

SEQ ID NO: 5688 - protein, 72 aa, Canis lupus familiaris
PPPGAPPHQLRASDMRRAVAAGRSLAPLPPSHASDLLSRACVQRPGSAADVEEPAAGCGDPGPRGGLSADAR

SEQ ID NO: 5689 - protein, 8 aa, Canis lupus familiaris
PPPGARSR

SEQ ID NO: 5690 - protein, 25 aa, Canis lupus familiaris
PPPHLQALLCLSRQIFRLPLWGQRL

SEQ ID NO: 5691 - protein, 27 aa, Canis lupus familiaris
PPPLPVPEGRWPGGGRPLQEQGSLSVH

SEQ ID NO: 5692 - protein, 89 aa, Canis lupus familiaris
PPPLRPPPPRLGSSHAVCSLAGLRAQQEQEKEEDRFHSLQRLRADLAPPGKSGRELEDGDGGGPEPRGHQLRRDAEHAEVRRPGQADPL

SEQ ID NO: 5693 - protein, 37 aa, Canis lupus familiaris
PPPLRRRPDPWQDPGEWVQVGPPPHQAPSLPGRAGHQ

SEQ ID NO: 5694 - protein, 19 aa, Canis lupus familiaris
PPPPARGILGQKAQWPRAS

SEQ ID NO: 5695 - protein, 42 aa, Canis lupus familiaris
PPPPASRTPSSWWRPCASSGSPSSCSCASSPAPAKPPSRGTS

SEQ ID NO: 5696 - protein, 36 aa, Canis lupus familiaris
PPPPGGGVPGPGPQRRRSTAEGLGPRASGRRGRAPR

SEQ ID NO: 5697 - protein, 30 aa, Canis lupus familiaris
PPPPGPPFLPGRSERLLEPPEFVTDAVGRY

SEQ ID NO: 5698 - protein, 12 aa, Canis lupus familiaris
PPPPPKPCPPPW

SEQ ID NO: 5699 - protein, 93 aa, Canis lupus familiaris
PPPPPPLWPASCTAPRSLTTPQESSSRRRPPAHLPPVTWALAGLGLNPRPLAPKTAVDRSPLGLVVLSSRMSMPRSASCSPSSMTSQRSGTPS

SEQ ID NO: 5700 - protein, 12 aa, Canis lupus familiaris
PPPPRGPCRSAS

SEQ ID NO: 5701 - protein, 9 aa, Canis lupus familiaris
PPPPTSLHT

SEQ ID NO: 5702 - protein, 54 aa, Canis lupus familiaris
PPPQESSRGRRYQQTQLLPLVLTQMARVFWFWMNKDLQKKFFLNISSTITWQAL

SEQ ID NO: 5703 - protein, 24 aa, Canis lupus familiaris
PPPRPPRPLRRRPPRLWAPTTQAA

SEQ ID NO: 5704 - skipped

SEQ ID NO: 5705 - protein, 23 aa, Canis lupus familiaris
PPPRRVAAATRIEIASTIRRTCG

SEQ ID NO: 5706 - protein, 23 aa, Canis lupus familiaris
PPPSPLCAPPAALAAPAHLSGGH

SEQ ID NO: 5707 - skipped

SEQ ID NO: 5708 - protein, 32 aa, Canis lupus familiaris
PPPWARPGDQRQRGPGARLGPHGGASPAADPG

SEQ ID NO: 5709 - protein, 79 aa, Canis lupus familiaris
PPQALSGTGTGMGTRRTQPQTLRWTRPWTGRSLRTQSRTPRGPALSPAPGDRPRSGWAGEGRSAPPGARKASALSPKPS

SEQ ID NO: 5710 - protein, 12 aa, Canis lupus familiaris
PPQPPAPAPAAE

SEQ ID NO: 5711 - protein, 59 aa, Canis lupus familiaris
PPQPVQRRSYPGRVGREIWQSTCPRKPPRLCPWTCRQAGTRASRPWRAWHPRPVPRPQL

SEQ ID NO: 5712 - protein, 66 aa, Canis lupus familiaris
PPQTARRRRRQRRPWYMVPCPSHCWGRTRCCSAGPGPVGPGGPAPTSLERHSAAASVGGASGGVRL

SEQ ID NO: 5713 - protein, 8 aa, Canis lupus familiaris
PPRAASAR

SEQ ID NO: 5714 - protein, 23 aa, Canis lupus familiaris
PPRAATPATPPGAPISTASTAGW

SEQ ID NO: 5715 - protein, 74 aa, Canis lupus familiaris
PPRAHGWGAPRRGRCRRWGQAPGASSWARGLWHRLASPIPRSRAGRTLGLRPRERPPLRAASRLRGWAGRASPG

SEQ ID NO: 5716 - protein, 77 aa, Canis lupus familiaris
PPRAPHLRGGAPAAGPDGKRPSRSAAGAGRKPEAGVLAHAPSAQGRERVFRRMRRPRRAQSLGAVGVGRSWGAARVE

SEQ ID NO: 5717 - protein, 25 aa, Canis lupus familiaris
PPRASTTPSAPCFRTSTTTPSTPSS

SEQ ID NO: 5718 - protein, 43 aa, Canis lupus familiaris
PPRGPGGRPQAPARPLQAQAPSADQLPPGPRRPRADPEGHKEQ

SEQ ID NO: 5719 - protein, 92 aa, Canis lupus familiaris
PPRHLAAEHPHPVQGPKLPGPFHQPPEPAGPCLLCRHRLGGVWPGASGHGRCPRVPEVPVQPRAEQPGGTGAGSRGPPGGEARRARGAVSQE

SEQ ID NO: 5720 - protein, 44 aa, Canis lupus familiaris
PPRHPPGYRRWGHQWLWVALGGRERLSFQKTRARFHRGCGGCKD

SEQ ID NO: 5721 - protein, 76 aa, Canis lupus familiaris
PPRLLLLSPPFGPLASALPPCTVEALPAGGAVTSSAPPSPQSWPRIMNSTRMPMSGPLSPTPPSSARPFWKPPTGS

SEQ ID NO: 5722 - protein, 35 aa, Canis lupus familiaris
PPRLLTRRLLSCRTPGPTRTRKRRRPISFPTETPC

SEQ ID NO: 5723 - protein, 40 aa, Canis lupus familiaris
PPRPARPAHPPMQAPKLSPSSTRTSQSRHPRWPCKGTTLS

SEQ ID NO: 5724 - protein, 23 aa, Canis lupus familiaris
PPRPDLWLQTLLAGGGGRGGGWW

SEQ ID NO: 5725 - protein, 19 aa, Canis lupus familiaris
PPRPFPSPARPPALRGCAS

SEQ ID NO: 5726 - protein, 80 aa, Canis lupus familiaris
PPRPVHPAWMHLAGPAGRSNDPDSPAGQDAGAAARRKGAEALSRTWALAPANLPAAARRPGALGDLGAAPPPLRLRQPRV

SEQ ID NO: 5727 - protein, 36 aa, Canis lupus familiaris
PPRQDLQDSHALHCQAKISSVDITSTLSSSEPSGQF

SEQ ID NO: 5728 - protein, 26 aa, Canis lupus familiaris
PPRRWGCAAAWWPDCCTTFSWAPSAG

SEQ ID NO: 5729 - protein, 11 aa, Canis lupus familiaris
PPRSCTGYGVP

SEQ ID NO: 5730 - skipped

SEQ ID NO: 5731 - protein, 24 aa, Canis lupus familiaris
PPSCTTRCSTSSSPGLTRSAAHLT

SEQ ID NO: 5732 - protein, 52 aa, Canis lupus familiaris
PPSFPWPPSAANWSLRADLHSQNWRTPLRLSPCTWGSWASRCLQSWRSWTTL

SEQ ID NO: 5733 - protein, 17 aa, Canis lupus familiaris
PPSFRPTRPSCPGSRTW

SEQ ID NO: 5734 - protein, 82 aa, Canis lupus familiaris
PPSGKPAGLRWGWTPLPHTIQEIHRSAGSRGSPGGPDPEGSGAGESASAQRLEPPAATKAAFLWKTQEIHAQASQGGSLHPA

SEQ ID NO: 5735 - protein, 81 aa, Canis lupus familiaris
PPSGQAPTASCTRGRPCTAPRSPRSLSRGSRGPSACPRWSGLSSESSRRSTSRAAGAWGHWKSWRMPSAWRRSPVLASRTS

SEQ ID NO: 5736 - protein, 19 aa, Canis lupus familiaris
PPSGSPLREPRLRWAIARA

SEQ ID NO: 5737 - protein, 54 aa, Canis lupus familiaris
PPSMVATVSTILEKRTVSLCPMTPGCLRDVPCVNAGAAGCTAFGRHFYQGVMAT

SEQ ID NO: 5738 - protein, 15 aa, Canis lupus familiaris
PPSQIRHSLYPCDIF

SEQ ID NO: 5739 - protein, 33 aa, Canis lupus familiaris
PPSRAAPPASSPTAAWLWVKIGSPSPSLKCTGL

SEQ ID NO: 5740 - protein, 35 aa, Canis lupus familiaris
PPSRCPTGRSRRPTRGPAPCSSGTPNSSGSSTASR

SEQ ID NO: 5741 - protein, 63 aa, Canis lupus familiaris
PPSSAFARQARWQQRWPPRRLPDPALPGSAAHAPVPGGAADAAQHARVPSAARAQEPRRVHQH

SEQ ID NO: 5742 - protein, 43 aa, Canis lupus familiaris
PPSSHMHTPPSRKQKQKQKKKKKKKKKVVVLSSTRKQLIRLSP

SEQ ID NO: 5743 - protein, 9 aa, Canis lupus familiaris
PPTERKPVI

SEQ ID NO: 5744 - protein, 9 aa, Canis lupus familiaris
PPTESDFIA

SEQ ID NO: 5745 - protein, 87 aa, Canis lupus familiaris
PPTPCPRPQPCPHSSMPSPCLCPCPSGPSRRRGQKHGHRMKRMGRPLRRTWTASRRACARWCCGRPRTPRSSGTCRGRGSTPATSRS

SEQ ID NO: 5746 - protein, 36 aa, Canis lupus familiaris
PPTPSQALVQPGCFWPWAGSSSPCTSLPAWSQCHST

SEQ ID NO: 5747 - protein, 24 aa, Canis lupus familiaris
PPTPSWPLQRSAPRAGMRMLSTWC

SEQ ID NO: 5748 - protein, 23 aa, Canis lupus familiaris
PPTPTGPACQQTDQCREAVQRDH

SEQ ID NO: 5749 - protein, 28 aa, Canis lupus familiaris
PPTRCSRKSTRWWSSGGRPRAQLPLPPP

SEQ ID NO: 5750 - skipped

SEQ ID NO: 5751 - protein, 16 aa, Canis lupus familiaris
PPVPQRHGFGGPARRL

SEQ ID NO: 5752 - protein, 40 aa, Canis lupus familiaris
PPVPSEWLVEAPALLPGGGLGHIPHLGCCQLWHLHSLPAT

SEQ ID NO: 5753 - protein, 39 aa, Canis lupus familiaris
PPVPVPVPALAPDPSSALVPPPFTNPSPTPVPAPCPVFA

SEQ ID NO: 5754 - protein, 46 aa, Canis lupus familiaris
PPVTSLRCGRKTLRSGPSAQRSPSRAPATRWEASPRGRNTSSESGL

SEQ ID NO: 5755 - protein, 27 aa, Canis lupus familiaris
PPWEQHSHSGQWRDLRAVPAESCPSPE

SEQ ID NO: 5756 - protein, 30 aa, Canis lupus familiaris
PPWGTAALGAVNPPPLRRPNQKAPRPRLPS

SEQ ID NO: 5757 - protein, 36 aa, Canis lupus familiaris
PQAAGRRPVDPAGAVLRARTAHGRLPRPSDRRCGDP

SEQ ID NO: 5758 - protein, 36 aa, Canis lupus familiaris
PQAISWHILLPVWQSLGRRGIEPRAPLPVRTAHRSE

SEQ ID NO: 5759 - protein, 15 aa, Canis lupus familiaris
PQALGRGAMQQAWSL

SEQ ID NO: 5760 - protein, 44 aa, Canis lupus familiaris
PQALRNSFAWPWSCLRGSRRSRNDGGSRRRKTYRGSCNSRSRST

SEQ ID NO: 5761 - protein, 74 aa, Canis lupus familiaris
PQANGTAAQIRPLSPRLKPLELKTQPWTPPRGLGHYPGPSRDSCLIFNLPRGCQGLQVPHSQCIELPWQTGRQN

SEQ ID NO: 5762 - protein, 21 aa, Canis lupus familiaris
PQAPAVLAKELPVKVILPVLA

SEQ ID NO: 5763 - protein, 39 aa, Canis lupus familiaris
PQAPPTLKGRCLLLQPPSQPQQPAARPRKPFPARVCLTG

SEQ ID NO: 5764 - protein, 63 aa, Canis lupus familiaris
PQAPREPLLQSPPTAILTGLLTGVPWISPRVLKMTPFWIPTISHIIHYMLILDPDSILFLRSS

SEQ ID NO: 5765 - protein, 65 aa, Canis lupus familiaris
PQARTGSPLAAGWRLSSPRTPGEPTRGHLHTPGSPVPNPTPAASAAHTVWTRTQSGETTTWTWPG

SEQ ID NO: 5766 - protein, 52 aa, Canis lupus familiaris
PQASPPIPTLEKTTMITPRSKWMTSPLPLPPPLSAALPRWRFSPTGHLQLPT

SEQ ID NO: 5767 - protein, 28 aa, Canis lupus familiaris
PQATLALPSVPEKGVIATGLRPESWRRC

SEQ ID NO: 5768 - protein, 37 aa, Canis lupus familiaris
PQAWAAVPAAAAALTAPRALPRPGAPPAPSRPPAGPS

SEQ ID NO: 5769 - protein, 72 aa, Canis lupus familiaris
PQCLPEACCMVITPYTLTPSTTPWVTPPQPCLPGLCASLLSTLSRPPPPAPSRVWTAATLHCLAVPAAACPP

SEQ ID NO: 5770 - skipped

SEQ ID NO: 5771 - protein, 10 aa, Canis lupus familiaris
PQCPLREIPL

SEQ ID NO: 5772 - protein, 22 aa, Canis lupus familiaris
PQCQSAMCALSVGRALADGTTW

SEQ ID NO: 5773 - protein, 46 aa, Canis lupus familiaris
PQCSFLARKLRAESLLWIKEKLPSVLPRRMLRGFGCWTEFGLSPSM

SEQ ID NO: 5774 - protein, 17 aa, Canis lupus familiaris
PQCSFLARKLRSWLSGC

SEQ ID NO: 5775 - protein, 22 aa, Canis lupus familiaris
PQDPRLWPCTGVTQRALAAPRP

SEQ ID NO: 5776 - protein, 24 aa, Canis lupus familiaris
PQDRHCLWGPPGLCSIQQALPLWG

SEQ ID NO: 5777 - protein, 12 aa, Canis lupus familiaris
PQDSSPQVLASV

SEQ ID NO: 5778 - protein, 43 aa, Canis lupus familiaris
PQDWTPGRLGPRPGTPDTPVPSSARYRAWPGTRAARAPYTTST

SEQ ID NO: 5779 - skipped

SEQ ID NO: 5780 - protein, 32 aa, Canis lupus familiaris
PQEPFWGPHLHLCPPPGLVPHLGPLVQPGLTG

SEQ ID NO: 5781 - protein, 65 aa, Canis lupus familiaris
PQEPRPPPLKSARAPRRPGAPRAAGRRPEPRGRPPKRRRRTGPPPPPRTGVRRVKLSPRSRAQAP

SEQ ID NO: 5782 - skipped

SEQ ID NO: 5783 - protein, 9 aa, Canis lupus familiaris
PQEREEPQQ

SEQ ID NO: 5784 - protein, 52 aa, Canis lupus familiaris
PQESSRGRRYQQTQLLPLVLTQMARVFWFWMNKDLQKKFFLNISSTITWQAL

SEQ ID NO: 5785 - protein, 80 aa, Canis lupus familiaris
PQFGARNCKSGAKDGWQAWSSFCIRRECRNLSSNFMPLGEKPSLQSKEWRIKTKAIIAAVLILKSAPSSGLSPVIPWSLS

SEQ ID NO: 5786 - protein, 76 aa, Canis lupus familiaris
PQFHPLCHSPTPGHHQQHKSQPSRQPLGHRLVGPEPQHGKHNGGVELRAESSPHEQQPFGHYPSPGLWWNPAPYQP

SEQ ID NO: 5787 - protein, 52 aa, Canis lupus familiaris
PQFHPLCHSPTPGHHQQHKSQPSRQPLGHRLVGPEPQHGPWPLVEPCPLPAL

SEQ ID NO: 5788 - protein, 40 aa, Canis lupus familiaris
PQFHPLCHSPTPGHHQQHKSQPSRQPLGHRLVGPEPQHGV

SEQ ID NO: 5789 - skipped

SEQ ID NO: 5790 - protein, 13 aa, Canis lupus familiaris
PQGHPRQKQMPHC

SEQ ID NO: 5791 - protein, 17 aa, Canis lupus familiaris
PQGLIMMKGTSARDSWN

SEQ ID NO: 5792 - protein, 52 aa, Canis lupus familiaris
PQGPQPTPPAAAAMGRRGHCQGWRRRAPRGVASGTRTSHTSCGARCPPPPCH

SEQ ID NO: 5793 - protein, 20 aa, Canis lupus familiaris
PQGRRRGNTGCGRHTAERYS

SEQ ID NO: 5794 - protein, 28 aa, Canis lupus familiaris
PQGSLLHLLLQGQHLWPSLRLRLRPPQT

SEQ ID NO: 5795 - protein, 16 aa, Canis lupus familiaris
PQGSLVAWEVLRNWKL

SEQ ID NO: 5796 - skipped

SEQ ID NO: 5797 - protein, 20 aa, Canis lupus familiaris
PQHPSRRTEVSVLPHNVLNF

SEQ ID NO: 5798 - protein, 13 aa, Canis lupus familiaris
PQHQRPGSPSLPS

SEQ ID NO: 5799 - protein, 24 aa, Canis lupus familiaris
PQHRPPHPGCRSLRTASSETPQTT

SEQ ID NO: 5800 - protein, 10 aa, Canis lupus familiaris
PQHWHRSACS

SEQ ID NO: 5801 - protein, 54 aa, Canis lupus familiaris
PQIPLPSKFSSLPGAVSCMSPRWWWKVCLARRPAPYGSGAEALMMRDTCHPTSS

SEQ ID NO: 5802 - protein, 38 aa, Canis lupus familiaris
PQISLLKSSGHLVPHLMNGGESHSLMPGLLQLCLWSDT

SEQ ID NO: 5803 - protein, 38 aa, Canis lupus familiaris
PQKMPLSIRCHPSMLTLHLTCTGDSLWRPQIGTSSFPL

SEQ ID NO: 5804 - protein, 49 aa, Canis lupus familiaris
PQKRKPVGTPPTPTRGPASLHPLACDLWCPQKPGPPAPSCPTETSCAVL

SEQ ID NO: 5805 - protein, 30 aa, Canis lupus familiaris
PQKVSEHPSSMQSLPPMQWSTSAPLRSPME

SEQ ID NO: 5806 - protein, 14 aa, Canis lupus familiaris
PQLLAGGDQPEVLP

SEQ ID NO: 5807 - protein, 56 aa, Canis lupus familiaris
PQLLPPNCTGIKKQFPLWPQRATDLQFHSTTFPLFPDGPGRLEEYRPPQPLLPRQL

SEQ ID NO: 5808 - protein, 36 aa, Canis lupus familiaris
PQLMLLRSRSLKTASRHWSLTPQSLPAPEGFSWMPT

SEQ ID NO: 5809 - protein, 17 aa, Canis lupus familiaris
PQLPGKWAEGGKTAKRD

SEQ ID NO: 5810 - protein, 40 aa, Canis lupus familiaris
PQLPWPPQQPQPLLPGPQWRKRWAPGGGTSLGLSMNAGPS

SEQ ID NO: 5811 - protein, 22 aa, Canis lupus familiaris
PQLQVNAGPLTARAVAEKDAPH

SEQ ID NO: 5812 - protein, 92 aa, Canis lupus familiaris
PQLRAQDGGVEGGPRTGRAGRTRLPSSGGRAQHLDSPQHRPGARGRRRSRCQQTRTGARPRPHVPARPPSLGSRERRAAQTNTGPKALAARL

SEQ ID NO: 5813 - protein, 21 aa, Canis lupus familiaris
PQLRTSPESDSSQKSSQAAMV

SEQ ID NO: 5814 - protein, 14 aa, Canis lupus familiaris
PQLYELHETHSVAQ

SEQ ID NO: 5815 - protein, 42 aa, Canis lupus familiaris
PQLYSPQSRTEEAEAWGHLCRLRGGCKWSWRKQRARGRWGGP

SEQ ID NO: 5816 - protein, 21 aa, Canis lupus familiaris
PQMAQQVPQTLATSEWRPACS

SEQ ID NO: 5817 - protein, 38 aa, Canis lupus familiaris
PQPAAIHSLRHSGAVSRACGRTQRGPYPPGAPPGQRLR

SEQ ID NO: 5818 - protein, 39 aa, Canis lupus familiaris
PQPCGPHHRRPRVSSPSSRLWTRCQTVAAPAGIWAQYGH

SEQ ID NO: 5819 - protein, 45 aa, Canis lupus familiaris
PQPCLPGLCASLLSTLSRPPPPAPSRVWTAATLHCLAVPAAACPP

SEQ ID NO: 5820 - protein, 17 aa, Canis lupus familiaris
PQPGARLPVTASPGLTS

SEQ ID NO: 5821 - protein, 21 aa, Canis lupus familiaris
PQPGPLRPDLRSHLLLLPLRP

SEQ ID NO: 5822 - protein, 68 aa, Canis lupus familiaris
PQPHCRPSEQKRQPRPTAKKGGREEGGGGRRPWGRRPQAHAPLQLHVYPLYDQPPSPPVPLHPEPALL

SEQ ID NO: 5823 - protein, 87 aa, Canis lupus familiaris
PQPHPAAEAGPRSLSPPCGWRGLSPTRNSTAASRPSTAAPGLRSPHPVEEVTAPSGEPGRCPSLCPARLGPGAGSSTAVPAASWKRS

SEQ ID NO: 5824 - protein, 12 aa, Canis lupus familiaris
PQPHPSCEGTPS

SEQ ID NO: 5825 - protein, 51 aa, Canis lupus familiaris
PQPLLALRMPLRQALASYGSHLALLGNVEKLKAACHPERLRPLVRAPRRRK

SEQ ID NO: 5826 - protein, 20 aa, Canis lupus familiaris
PQPLLPGLCPRDRCWVCCQW

SEQ ID NO: 5827 - skipped

SEQ ID NO: 5828 - protein, 58 aa, Canis lupus familiaris
PQPPPLGSPGGQAQPPAHLPPLLRLLMAPPVLPALTSRSPASSSLAPRWAWCWLCAKP

SEQ ID NO: 5829 - protein, 44 aa, Canis lupus familiaris
PQPQCPLHIPPHTMGSWSHRSPPVPSPRLGLRRPWRGCRRQRRS

SEQ ID NO: 5830 - protein, 46 aa, Canis lupus familiaris
PQPQCPPMKNPARSSSISLARICILGEQKQPWSSSSSLDSSSLSPR

SEQ ID NO: 5831 - protein, 91 aa, Canis lupus familiaris
PQPQRPHDGASCSASCGPPWLPAPPPWHHGTLPESSGASKHGPDAESDTSTGHGQRWTPELWRWHAAPTQLPRRPRPAHHEHGPWSARPVG

SEQ ID NO: 5832 - protein, 14 aa, Canis lupus familiaris
PQPQRSFIRSPESA

SEQ ID NO: 5833 - protein, 17 aa, Canis lupus familiaris
PQPRIKRRTKSRQPRRR

SEQ ID NO: 5834 - skipped

SEQ ID NO: 5835 - protein, 11 aa, Canis lupus familiaris
PQPRSASDVRS

SEQ ID NO: 5836 - protein, 45 aa, Canis lupus familiaris
PQPRSLVGASWAGARPSPTRGPTWRRCRWTASTCAAASWCRSAGC

SEQ ID NO: 5837 - protein, 18 aa, Canis lupus familiaris
PQPSPLNPGPGALPQRPT

SEQ ID NO: 5838 - protein, 41 aa, Canis lupus familiaris
PQPTCREWTGARAWPDGLRPGQPSVVPQPKALHQHLEPPSK

SEQ ID NO: 5839 - skipped

SEQ ID NO: 5840 - protein, 26 aa, Canis lupus familiaris
PQPVAARPAQAALPSPHRTARSQRGL

SEQ ID NO: 5841 - protein, 42 aa, Canis lupus familiaris
PQQKMRKEPQSLPLGASSGDISLAPERLSGRPGPQTGSPPTG

SEQ ID NO: 5842 - protein, 59 aa, Canis lupus familiaris
PQQLLPRLQRPFLPHPRHLPPTLPPMPQAPQTFQAKHPWQPARGSHGPRQAWAPSGRKR

SEQ ID NO: 5843 - protein, 9 aa, Canis lupus familiaris
PQQSRTLSS

SEQ ID NO: 5844 - protein, 14 aa, Canis lupus familiaris
PQQTGTVPATLSSL

SEQ ID NO: 5845 - protein, 18 aa, Canis lupus familiaris
PQRAGGLCVVHRGPGVLE

SEQ ID NO: 5846 - protein, 13 aa, Canis lupus familiaris
PQRAPGRPPRGSG

SEQ ID NO: 5847 - protein, 16 aa, Canis lupus familiaris
PQRAPNIWSQGSALPR

SEQ ID NO: 5848 - protein, 22 aa, Canis lupus familiaris
PQRAPQSLSKTRQRMRARTQLC

SEQ ID NO: 5849 - protein, 38 aa, Canis lupus familiaris
PQRGSGRPPLSPHPPMSEIILKPVLPPMEPPPPYSFMP

SEQ ID NO: 5850 - protein, 20 aa, Canis lupus familiaris
PQRGSGRPPLSPHPPMSRSF

SEQ ID NO: 5851 - protein, 34 aa, Canis lupus familiaris
PQRGSRRPLGQGPAATRRAVRFRGPFWNIEVRVH

SEQ ID NO: 5852 - protein, 20 aa, Canis lupus familiaris
PQRLLPGNGVRRAQNGWCRH

SEQ ID NO: 5853 - protein, 9 aa, Canis lupus familiaris
PQRLPWTLA

SEQ ID NO: 5854 - protein, 46 aa, Canis lupus familiaris
PQRLRILPPSPSPRRLPCRGPTTARPARRTFCSRPRRCCGTADSTC

SEQ ID NO: 5855 - protein, 11 aa, Canis lupus familiaris
PQRRGLLLQGP

SEQ ID NO: 5856 - protein, 38 aa, Canis lupus familiaris
PQRSLMLWRRMGRRVCTRRQPWASAPSATTSWRLGPLS

SEQ ID NO: 5857 - skipped

SEQ ID NO: 5858 - protein, 56 aa, Canis lupus familiaris
PQRTRASRQWGSTLPRRRLCSSTVLVPAPRLTSLPPHLSPIKASPLGAPRNWSSST

SEQ ID NO: 5859 - protein, 50 aa, Canis lupus familiaris
PQRTRASRQWGSTLPRTPPPWAACLGTRTMSSRWRPGRPMLCPTSWSSST

SEQ ID NO: 5860 - protein, 10 aa, Canis lupus familiaris
PQRTRRPCCT

SEQ ID NO: 5861 - protein, 17 aa, Canis lupus familiaris
PQRWSWIQLWQHSTSTI

SEQ ID NO: 5862 - protein, 20 aa, Canis lupus familiaris
PQRWTTVLRGPLHGMQETRP

SEQ ID NO: 5863 - skipped

SEQ ID NO: 5864 - protein, 50 aa, Canis lupus familiaris
PQSEDLTHQTPRSEEGRLVRLPLSAAVKTPRRPPRLPRMSVRKPLIRKLS

SEQ ID NO: 5865 - protein, 35 aa, Canis lupus familiaris
PQSHEDDSGQPATPTEKPAQGVTIPEGLPGPPAGA

SEQ ID NO: 5866 - protein, 34 aa, Canis lupus familiaris
PQSLLFHHPLCHPGPATAMGGPALHALLCLELGL

SEQ ID NO: 5867 - protein, 15 aa, Canis lupus familiaris
PQSLRRRPLGREQVC

SEQ ID NO: 5868 - protein, 36 aa, Canis lupus familiaris
PQSPDLLQKGTPPRRRHHHLRCQPWSLTLPQTPLQP

SEQ ID NO: 5869 - protein, 11 aa, Canis lupus familiaris
PQSPRRPPALS

SEQ ID NO: 5870 - protein, 94 aa, Canis lupus familiaris
PQSPVTPAGSRTLQVWISTLLAEILSPLATSSTLCTRNWTWTLFMKIFPSPCRAPRQRLQRAPLNPARLPKQRISQGLHERSSNPCSLNWRRKL

SEQ ID NO: 5871 - protein, 42 aa, Canis lupus familiaris
PQSRPGGAHPRAAPTAHGPQPWARTVPGTRGSQKPLGQWRPD

SEQ ID NO: 5872 - protein, 39 aa, Canis lupus familiaris
PQSSASCCHLIPCPCDQLWTPGAWGCFSSALPLLVSLGM

SEQ ID NO: 5873 - protein, 46 aa, Canis lupus familiaris
PQSTASTMGPCTNTERSSVPMSCSLPACPTSVSSAAVLRARSTAVS

SEQ ID NO: 5874 - protein, 16 aa, Canis lupus familiaris
PQSWGIRHEWGRGLSG

SEQ ID NO: 5875 - protein, 80 aa, Canis lupus familiaris
PQTGMVQRPVQFPWRMDWVQPRDPQRNSLAPHLLPAFRRLVKVQPRVKAGLQPQLPCRGAARKKRKRPSGCSTVLCARWQ

SEQ ID NO: 5876-5877 - skipped (2 entries)

SEQ ID NO: 5878 - protein, 24 aa, Canis lupus familiaris
PQTSFYLKPLNLSTSITAPSKRQK

SEQ ID NO: 5879 - protein, 13 aa, Canis lupus familiaris
PQTSLSALKSSGT

SEQ ID NO: 5880 - protein, 18 aa, Canis lupus familiaris
PQTSPGSRTSSCQATPVP

SEQ ID NO: 5881 - protein, 40 aa, Canis lupus familiaris
PQTVSAVTYLKLALRDWLRCARGMLPHLTAAPKRRSAPGR

SEQ ID NO: 5882 - protein, 26 aa, Canis lupus familiaris
PQVLVYSGNLQFFSRRAMKFNVKSKN

SEQ ID NO: 5883 - protein, 20 aa, Canis lupus familiaris
PQVPASRAQPPASLDRSSVL

SEQ ID NO: 5884 - protein, 64 aa, Canis lupus familiaris
PQVRRRSRGTSPVLPLKHPPNCCNHSAWPPGLQAQAAMPCWPSWTLFTQRGQAVLFPQALQPQM

SEQ ID NO: 5885 - protein, 49 aa, Canis lupus familiaris
PQVSLTGSPRAWPAWGLPLAPRGPPPALPGTRSLRRCPAWVGPRTRSQC

SEQ ID NO: 5886 - protein, 9 aa, Canis lupus familiaris
PQVTSSRSR

SEQ ID NO: 5887 - protein, 19 aa, Canis lupus familiaris
PQVTWGTLWWWRAPRILRL

SEQ ID NO: 5888 - protein, 11 aa, Canis lupus familiaris
PQWISTRSWMI

SEQ ID NO: 5889 - protein, 69 aa, Canis lupus familiaris
PQWPPARPPPLCSPPAEPIGPRRCPRPPVAARPGRSPSSDCQVPAAVRHPPSSDPQLRSPAPIWAPPSP

SEQ ID NO: 5890-5891 - skipped (2 entries)

SEQ ID NO: 5892 - protein, 23 aa, Canis lupus familiaris
PRAAAASRRPRPPPRRAPGAPGR

SEQ ID NO: 5893 - protein, 22 aa, Canis lupus familiaris
PRAAGPLRRRPPRGSLPPPASG

SEQ ID NO: 5894 - protein, 15 aa, Canis lupus familiaris
PRAAGQDPGRGPHIQ

SEQ ID NO: 5895 - protein, 41 aa, Canis lupus familiaris
PRAAGRRGHIPVDQAKCQLNHRGWPHHPEGGGISHHYRHLG

SEQ ID NO: 5896 - protein, 35 aa, Canis lupus familiaris
PRAARWRTEESLPASIPSRAVVQERTASIFILQHI

SEQ ID NO: 5897 - protein, 45 aa, Canis lupus familiaris
PRAATRKRPSLALSPASNHCASQPLPGIWGYMVLRKEPQPCTFPT

SEQ ID NO: 5898 - protein, 78 aa, Canis lupus familiaris
PRACFSTTPSATLGQPLPWGAQPSMLSSAWSSASDFFLPNPWGASLLPWGLPCPTWGGPRCNYPSLPACASALGDTTS

SEQ ID NO: 5899 - protein, 42 aa, Canis lupus familiaris
PRACGNQRGRGFREPQEQDSAWRTQHPASRDKGSGPRELRRR

SEQ ID NO: 5900 - protein, 25 aa, Canis lupus familiaris
PRACPWADPGRPPCPRRPTRPPAGP

SEQ ID NO: 5901 - protein, 60 aa, Canis lupus familiaris
PRACRPQCQPGACSRSLLPPPLCHTRLLLEPLGWEVRWRRLRARGLGWAALRPASGWMRS

SEQ ID NO: 5902 - skipped

SEQ ID NO: 5903 - protein, 90 aa, Canis lupus familiaris
PRAGPRSPGLRTVRWSSGIQTSQSLPRSWSEVWPGPTASSASSRTMWTRGSWTPQEPISKSSAQCPWALTIWLWRRSRSAASVWATPQMS

SEQ ID NO: 5904 - protein, 51 aa, Canis lupus familiaris
PRAHPPEAHPPTGRAVSSPLRRGGDRAVAWTRLPSPGASPGAPVPSRLTDP

SEQ ID NO: 5905 - protein, 40 aa, Canis lupus familiaris
PRAHRLRQTPLWGVQGTSPVPEDSPGPFGVSSRFRGSPLR

SEQ ID NO: 5906 - protein, 9 aa, Canis lupus familiaris
PRALPPAAT

SEQ ID NO: 5907 - protein, 9 aa, Canis lupus familiaris
PRAPASSPG

SEQ ID NO: 5908 - protein, 29 aa, Canis lupus familiaris
PRAPFSSQHPHGVSFPFSSSFGYSVPWSA

SEQ ID NO: 5909 - skipped

SEQ ID NO: 5910 - protein, 55 aa, Canis lupus familiaris
PRAPPKPPPAPTRAASPGSWSCWASRTCPRCGRCSPRSSWPCSCSRCWATRSSCC

SEQ ID NO: 5911 - protein, 55 aa, Canis lupus familiaris
PRAPPKPPPAPTRAASPVSWSCWASRTCPRCGRCSPRSSWPCSCSRCWATRSSCC

SEQ ID NO: 5912 - protein, 19 aa, Canis lupus familiaris
PRAPPQPWSRSLPGLPSVP

SEQ ID NO: 5913 - protein, 18 aa, Canis lupus familiaris
PRAPPWTRLSFRPPATRP

SEQ ID NO: 5914 - protein, 16 aa, Canis lupus familiaris
PRAPQSRGGIANAFVG

SEQ ID NO: 5915 - protein, 92 aa, Canis lupus familiaris
PRAPRPRPLPGGAPRARPRGWSPSRCRKMPSRSARILLSCPTSTSSRSTPVSSCPEASPPACRARSTARFPFPRKSWTSSPAPSVPSTCSSL

SEQ ID NO: 5916 - protein, 43 aa, Canis lupus familiaris
PRAPSGSPQTWKALSSLGSLASPLAAIRRLLALRGKTRWELST

SEQ ID NO: 5917 - protein, 35 aa, Canis lupus familiaris
PRAPSRPLRAPERAGRFCRVSRRRAGRWAGSRRLL

SEQ ID NO: 5918 - protein, 26 aa, Canis lupus familiaris
PRAQTFSRRGPLPAAATTTSDVSPGP

SEQ ID NO: 5919 - protein, 9 aa, Canis lupus familiaris
PRAREDLLP

SEQ ID NO: 5920 - protein, 26 aa, Canis lupus familiaris
PRARGAGLPPTAAQVSPALRQTATLL

SEQ ID NO: 5921 - protein, 92 aa, Canis lupus familiaris
PRARGMQQTRTLTTCLSCCSSATAAWARRPSCSATRMTPSHLPLSALWASTSRSRRSIVMTRGSSCRSGTRRARSATVQSPPPTTAEPWASC

SEQ ID NO: 5922 - protein, 24 aa, Canis lupus familiaris
PRARPAPPPPPPSRCPAASSGGSC

SEQ ID NO: 5923 - protein, 37 aa, Canis lupus familiaris
PRARPAWSPRGPRRALRRVLTQRALSLETKGTLGGQD

SEQ ID NO: 5924 - skipped

SEQ ID NO: 5925 - protein, 36 aa, Canis lupus familiaris
PRARPAWSPRGPRRALRRVLTQRGCRGVWGARRACG

SEQ ID NO: 5926 - protein, 11 aa, Canis lupus familiaris
PRASELSACRP

SEQ ID NO: 5927 - protein, 84 aa, Canis lupus familiaris
PRASSWTARSWAPRCRASWAAWARAPPRPASWTPAAARSSRSSRTSSRSTRTRTWSSWWASPTTTRCCTSRRAAPSTASRPRGS

SEQ ID NO: 5928 - protein, 16 aa, Canis lupus familiaris
PRATCHPLRMPPQLRS

SEQ ID NO: 5929 - protein, 32 aa, Canis lupus familiaris
PRATWCCRSSWCCLPWPRPRWWPFPAPRAARL

SEQ ID NO: 5930 - skipped

SEQ ID NO: 5931 - protein, 78 aa, Canis lupus familiaris
PRAWSLSPRELSAALQPVPAAETTESLPTSRATSACASFRLASVTNVSSSWSAEGSWLPRWPCVGNRRHSSRDIWLRA

SEQ ID NO: 5932 - protein, 42 aa, Canis lupus familiaris
PRCDLRSAEPLDPQTEDKCILSLPVRGAPSRAQCVCCSGHSL

SEQ ID NO: 5933 - protein, 42 aa, Canis lupus familiaris
PRCDLRSAEPLDPQTEDKCILSLPVRGAPSRAQRVCCSGHSL

SEQ ID NO: 5934 - protein, 70 aa, Canis lupus familiaris
PRCGRRAPTRRPCLPPRPRPACPATSTRPWSSWGPASRRRAGARPPSPSCSCRPPGPSSWCQLFPSAASQ

SEQ ID NO: 5935 - protein, 15 aa, Canis lupus familiaris
PRCHLCRCWSHISKY

SEQ ID NO: 5936 - protein, 33 aa, Canis lupus familiaris
PRCLCQCMSHCPRSSCSSSRTCTPVRSPPCLRS

SEQ ID NO: 5937 - skipped

SEQ ID NO: 5938 - protein, 20 aa, Canis lupus familiaris
PRCPHGMLPKIPWLPHRPLQ

SEQ ID NO: 5939 - protein, 35 aa, Canis lupus familiaris
PRCPRAPTAPRPGSPADRVRQVRPVLRAPGPPSTS

SEQ ID NO: 5940 - protein, 42 aa, Canis lupus familiaris
PRCPRQPPGSSPRPPRLRKPPTPQLWPRPPRPPPLPWPAPPG

SEQ ID NO: 5941 - protein, 28 aa, Canis lupus familiaris
PRCRVRTRNLRILWSRTESCRMRFPEAS

SEQ ID NO: 5942 - protein, 9 aa, Canis lupus familiaris
PRCSQARGS

SEQ ID NO: 5943 - protein, 48 aa, Canis lupus familiaris
PRCSRSPGPTSLHCPASNCGSSSSPCTGPCGERRPLKRGPSALSPGKR

SEQ ID NO: 5944 - protein, 17 aa, Canis lupus familiaris
PRCWCIQETSSFSQEGR

SEQ ID NO: 5945 - protein, 88 aa, Canis lupus familiaris
PRCWPPPSPRHCCCPRPPGTPGSSPRRPCRSAWEASLPLRASARRRRRELGRGWGCPRPGAPASACPPPWAVPGPPWAFPSQRRGRSP

SEQ ID NO: 5946 - protein, 33 aa, Canis lupus familiaris
PRDHLHLQGLGVLHLLEKNSEHPKALEQHGKIL

SEQ ID NO: 5947 - protein, 49 aa, Canis lupus familiaris
PRDHLHLQGLGVLHLLEKNSEVLEPLPVLGQLGERWKHPKALEQHGKIL

SEQ ID NO: 5948 - protein, 20 aa, Canis lupus familiaris
PRDHLHLQHPKALEQHGKIL

SEQ ID NO: 5949 - protein, 89 aa, Canis lupus familiaris
PRDSRPVPRSAGLFCRVTARCHPARHPCLSSTMSSAWPRTATTWMCRPPRTPLSPPRRQPPAGALQRTVGRPWPPGRCPQSPCAPAERR

SEQ ID NO: 5950 - skipped

SEQ ID NO: 5951 - protein, 15 aa, Canis lupus familiaris
PRDVAPSPRACEASF

SEQ ID NO: 5952 - protein, 9 aa, Canis lupus familiaris
PREGQDVHL

SEQ ID NO: 5953 - protein, 56 aa, Canis lupus familiaris
PRELRALGLAREPPAARRRRRSRDWSRVTRGTAPLRTRSWKRSKLESGRWRKKLRS

SEQ ID NO: 5954 - protein, 29 aa, Canis lupus familiaris
PREPGPAANGDRHYLALLHLGQRVWGLVL

SEQ ID NO: 5955 - protein, 24 aa, Canis lupus familiaris
PREPGPAANGDRHYLGAGSAAVPC

SEQ ID NO: 5956 - skipped

SEQ ID NO: 5957 - protein, 24 aa, Canis lupus familiaris
PRESGSGVGGGARSRRPRPLWDPN

SEQ ID NO: 5958 - protein, 20 aa, Canis lupus familiaris
PREWDSETQDVIARPDVYQK

SEQ ID NO: 5959 - protein, 9 aa, Canis lupus familiaris
PRFLCSHLP

SEQ ID NO: 5960 - protein, 19 aa, Canis lupus familiaris
PRFMVGARLPSTSAMPSAP

SEQ ID NO: 5961 - protein, 47 aa, Canis lupus familiaris
PRFPRTPGNGRTQASGLSCPRDPRSRCPRQRGRAGQGCPSCPAPPGS

SEQ ID NO: 5962 - protein, 27 aa, Canis lupus familiaris
PRFPWLRWMPLRKQTWPRGSRSLAIPR

SEQ ID NO: 5963 - protein, 11 aa, Canis lupus familiaris
PRGARAAPTWS

SEQ ID NO: 5964 - protein, 30 aa, Canis lupus familiaris
PRGARLGRARRLRREPAGANSSGSARGSRA

SEQ ID NO: 5965 - protein, 33 aa, Canis lupus familiaris
PRGCCCSRPPAARRRLKRWKARPPTPSCRPKRS

SEQ ID NO: 5966 - protein, 17 aa, Canis lupus familiaris
PRGCPPGGRLRWCWRRS

SEQ ID NO: 5967 - protein, 26 aa, Canis lupus familiaris
PRGGAMHRPYHSRPAGQTAAPSSSTL

SEQ ID NO: 5968 - protein, 95 aa, Canis lupus familiaris
PRGGGRNRHPQPSTCRCCRATASSSRPSPAAPQAATGPLHTCPTRVHLCRHLPASVLPLPQAPKLRAPGRPRQRQPPFWVTIRIPSGAFSITLAF

SEQ ID NO: 5969 - protein, 29 aa, Canis lupus familiaris
PRGGHGSSSGSTVPARSRGCSDDRAPGWG

SEQ ID NO: 5970 - protein, 27 aa, Canis lupus familiaris
PRGGHGSSSGSTVRARSRGCSDDRAPG

SEQ ID NO: 5971 - protein, 41 aa, Canis lupus familiaris
PRGGSALFVRSASQPRVIRTPWRTTWMDTSFSAPRTPLPLS

SEQ ID NO: 5972 - protein, 12 aa, Canis lupus familiaris
PRGGVCCSRGPK

SEQ ID NO: 5973 - protein, 28 aa, Canis lupus familiaris
PRGHAGPAVLERAAGSTVEDAAGGRSFL

SEQ ID NO: 5974 - skipped

SEQ ID NO: 5975 - protein, 25 aa, Canis lupus familiaris
PRGLPHRHPRCRSHPVRLRHRHRQC

SEQ ID NO: 5976 - protein, 25 aa, Canis lupus familiaris
PRGNASLTSSLNPRTSGSGWRCGRL

SEQ ID NO: 5977 - protein, 14 aa, Canis lupus familiaris
PRGPGRPGTAPPSA

SEQ ID NO: 5978 - protein, 15 aa, Canis lupus familiaris
PRGPGTVPYHPATTS

SEQ ID NO: 5979 - protein, 25 aa, Canis lupus familiaris
PRGPLPLSAESPSPRAYPELEPQPD

SEQ ID NO: 5980 - protein, 16 aa, Canis lupus familiaris
PRGPQVTRSFSITWTT

SEQ ID NO: 5981 - protein, 66 aa, Canis lupus familiaris
PRGPRGAGQGPAQHLQLHGHLCRGVREDLCSQGHPVCRAPRQTPSDQEDVRGLWGDGACLGGSLLQ

SEQ ID NO: 5982 - protein, 40 aa, Canis lupus familiaris
PRGPSSTCYSRGSTSGLPSASVSGRPRHEQASNGPARLPL

SEQ ID NO: 5983 - protein, 17 aa, Canis lupus familiaris
PRGQTSSRIQQFEAPLQ

SEQ ID NO: 5984 - protein, 25 aa, Canis lupus familiaris
PRGRGCCSSTAGAASCTSRRASAGR

SEQ ID NO: 5985 - protein, 10 aa, Canis lupus familiaris
PRGRKLLSGP

SEQ ID NO: 5986 - protein, 13 aa, Canis lupus familiaris
PRGRVSQPLNSAD

SEQ ID NO: 5987 - protein, 10 aa, Canis lupus familiaris
PRGRWRLGWS

SEQ ID NO: 5988 - skipped

SEQ ID NO: 5989 - protein, 19 aa, Canis lupus familiaris
PRGSHSTAAAPPCVGRAAR

SEQ ID NO: 5990 - protein, 21 aa, Canis lupus familiaris
PRGYVPPALSRLQPFPRSLGA

SEQ ID NO: 5991 - protein, 81 aa, Canis lupus familiaris
PRHAGHPSSTTASHVGRPSPRPAPSRFTSVHTPGRSPSAAPSAGGHSPQRATSRCIWARTCGIMPPRGVAAACPWKTPWLC

SEQ ID NO: 5992 - skipped

SEQ ID NO: 5993 - protein, 44 aa, Canis lupus familiaris
PRHHWSSLLATSTPSSAGSVRWNSRGPSLSRRSGCGTYSGTSWR

SEQ ID NO: 5994 - protein, 24 aa, Canis lupus familiaris
PRHQADYQQTLGHGSPNCRGHGIH

SEQ ID NO: 5995 - protein, 10 aa, Canis lupus familiaris
PRHQLWPRSR

SEQ ID NO: 5996 - protein, 12 aa, Canis lupus familiaris
PRHRIFRILQTP

SEQ ID NO: 5997 - protein, 22 aa, Canis lupus familiaris
PRHTASSAASSRCPPRRGGPVA

SEQ ID NO: 5998 - skipped

SEQ ID NO: 5999 - protein, 33 aa, Canis lupus familiaris
PRKAGVARWKGCSHTLKIISHKVTPKIISHKTT

SEQ ID NO: 6000 - protein, 54 aa, Canis lupus familiaris
PRKALGARAARNLGSEAWCPGGWGVQQPLLPCGPQAAELSWPCIPCRRAELWAE

SEQ ID NO: 6001 - protein, 13 aa, Canis lupus familiaris
PRKHCCKRIIHQS

SEQ ID NO: 6002 - protein, 9 aa, Canis lupus familiaris
PRKLIWTQS

SEQ ID NO: 6003 - protein, 11 aa, Canis lupus familiaris
PRKTLYYPGRP

SEQ ID NO: 6004 - protein, 25 aa, Canis lupus familiaris
PRLASRSPAGPRPPPPSPMGAPCTL

SEQ ID NO: 6005 - skipped

SEQ ID NO: 6006 - protein, 97 aa, Canis lupus familiaris
PRLCPPKLPGSCRFTAPRWMVRPPAPCPGPAVAPSPPPLVLLPLLRSSAWLLWAGAPPQRVPYLPRMAQAAFLATWRPRCRTLRPSASWPCSRRDSR

SEQ ID NO: 6007 - protein, 27 aa, Canis lupus familiaris
PRLEVPRDGRPLARVRRSQKTKRTWRG

SEQ ID NO: 6008 - protein, 36 aa, Canis lupus familiaris
PRLFCKTVVWCHGEVVMATTPGAKWNYPLLHSLCLG

SEQ ID NO: 6009 - protein, 12 aa, Canis lupus familiaris
PRLHHPHPHRLS

SEQ ID NO: 6010 - protein, 19 aa, Canis lupus familiaris
PRLHLGRWGANAGPGALGG

SEQ ID NO: 6011 - protein, 88 aa, Canis lupus familiaris
PRLHPQPTHSTKLLPLPHLGSCHITQVLSHWTLLQAGCPFIIRCPGYLLGTLCMKPLQQVPAQFLPLRRASLLWKQPLPTDRDSENEI

SEQ ID NO: 6012 - protein, 27 aa, Canis lupus familiaris
PRLKGTAGSTQKSLCPALESSLSLHWT

SEQ ID NO: 6013 - protein, 10 aa, Canis lupus familiaris
PRLLHGRRSW

SEQ ID NO: 6014 - protein, 25 aa, Canis lupus familiaris
PRLLHPPRQETLRDPDVPQMNFQAP

SEQ ID NO: 6015 - protein, 20 aa, Canis lupus familiaris
PRLLHPQMSRRCSPSGSLET

SEQ ID NO: 6016 - protein, 19 aa, Canis lupus familiaris
PRLLLPSRGKPQSLLPHSF

SEQ ID NO: 6017 - skipped

SEQ ID NO: 6018 - protein, 18 aa, Canis lupus familiaris
PRLPAGSRGRCRRGCCCC

SEQ ID NO: 6019 - skipped

SEQ ID NO: 6020 - protein, 20 aa, Canis lupus familiaris
PRLPASPDRTVAGAPRVPRP

SEQ ID NO: 6021 - protein, 15 aa, Canis lupus familiaris
PRLPCGQGGEAQASP

SEQ ID NO: 6022 - protein, 16 aa, Canis lupus familiaris
PRLPENPSCRAPPPRS

SEQ ID NO: 6023 - protein, 70 aa, Canis lupus familiaris
PRLPGRQPRLHTPEPEPEPEPEPEPEPAAGGQGGGYLGPGLVSRSALRRRRGRAGASVSSRAAGRGTPDV

SEQ ID NO: 6024 - protein, 19 aa, Canis lupus familiaris
PRLPLRGTQRCSQRRCRRA

SEQ ID NO: 6025 - protein, 64 aa, Canis lupus familiaris
PRLPPAATPAACAGVAVAAAPGTRSGGVRGGPPGTTSCSPCPAVRRAPRQAPRRCGAGRSRSTS

SEQ ID NO: 6026 - protein, 91 aa, Canis lupus familiaris
PRLPTCSTPTVCAPTRPGLGRRPWRCCGRRCGAGRRWAARAGTAGRSARRSRGPRSPRCRSTPRGGTRGPAGRRGPGSACCSALRSAGPSA

SEQ ID NO: 6027 - protein, 27 aa, Canis lupus familiaris
PRLQDTIRMESSKTSLCHILMLLETRG

SEQ ID NO: 6028 - protein, 44 aa, Canis lupus familiaris
PRLQGHIKEALQLPQVSGYHHLPGHSGCPPGAGRAHSGPEDHPG

SEQ ID NO: 6029 - skipped

SEQ ID NO: 6030 - protein, 20 aa, Canis lupus familiaris
PRLQPGEASGQPMPFLGGCT

SEQ ID NO: 6031 - protein, 11 aa, Canis lupus familiaris
PRLQRHLEARC

SEQ ID NO: 6032 - protein, 75 aa, Canis lupus familiaris
PRLRRHPHQPPTTSTRGRPPPSRLRRPRAAPTTLCAPALSPAWRRAWARGPQACMRPGRPWGRCPTPSGRSARAP

SEQ ID NO: 6033 - protein, 24 aa, Canis lupus familiaris
PRLSAAPAAPRQSSRCRCASASAA

SEQ ID NO: 6034 - protein, 30 aa, Canis lupus familiaris
PRLWKWAHSGLWTALWMGCSQLRRPKSTWR

SEQ ID NO: 6035 - protein, 15 aa, Canis lupus familiaris
PRMLGLALPWVPFLI

SEQ ID NO: 6036 - protein, 66 aa, Canis lupus familiaris
PRMPSTPTGWCGTSEGRARRSLEPMCPSSCGTCVSRGLMAQRPSRTVCPGRASRGSTCSPASGSCH

SEQ ID NO: 6037 - protein, 31 aa, Canis lupus familiaris
PRMTTTSMWTRSCVSRMRALPSQSPSCLPCT

SEQ ID NO: 6038 - protein, 20 aa, Canis lupus familiaris
PRNLWAFAGPRELLMPLSTR

SEQ ID NO: 6039 - skipped

SEQ ID NO: 6040 - protein, 35 aa, Canis lupus familiaris
PRNPLNPSSQPSLCNVSIMCPLNPAAQDGVRCPSC

SEQ ID NO: 6041 - skipped

SEQ ID NO: 6042 - protein, 23 aa, Canis lupus familiaris
PRNPSLLAHGPRHPHQLPHRSQQ

SEQ ID NO: 6043 - protein, 33 aa, Canis lupus familiaris
PRPAAGLRRLPVTPATPFLPMQIPHGPPRPYPA

SEQ ID NO: 6044 - protein, 26 aa, Canis lupus familiaris
PRPAAPRVIGDTWSCPGPRRRFWSTF

SEQ ID NO: 6045 - protein, 8 aa, Canis lupus familiaris
PRPAARRS

SEQ ID NO: 6046 - protein, 34 aa, Canis lupus familiaris
PRPAASRRSRARRWKPSRSTATTAWQRACSRLSW

SEQ ID NO: 6047 - protein, 38 aa, Canis lupus familiaris
PRPAASRSPPCWHPRTWGPLGAQPRAPHGRAVVAACHP

SEQ ID NO: 6048 - protein, 44 aa, Canis lupus familiaris
PRPAASRSPPCWHPRTWGPLGAQPRAPHGRLPQAPGPSASPRSS

SEQ ID NO: 6049 - skipped

SEQ ID NO: 6050 - protein, 95 aa, Canis lupus familiaris
PRPAATPRPWGPRRARHPSGEAGSSEGRALQCSVGLSWDCRMEKTMEKQLRPARRQWRDPWVKNSPTGTRQMMGKGSRVPGSRSRVSICISWWSS

SEQ ID NO: 6051 - protein, 19 aa, Canis lupus familiaris
PRPALAASATVARFQVHHA

SEQ ID NO: 6052 - protein, 94 aa, Canis lupus familiaris
PRPALCLALPLALGRLSKLPWPVPAPRRPAVPLSSRAAAANARPGAGSATARRTARTAATSTAAAGPACPPHSCVTASRTARMAQTRALTPARG

SEQ ID NO: 6053 - protein, 11 aa, Canis lupus familiaris
PRPALPSSWTP

SEQ ID NO: 6054 - protein, 50 aa, Canis lupus familiaris
PRPAPMAGVRTQKVASSASAPQASNPTRLAPSARMWMSVRITWHVLGRSV

SEQ ID NO: 6055 - skipped

SEQ ID NO: 6056 - protein, 40 aa, Canis lupus familiaris
PRPARPQPLACPPRRTTAPKPRRPRGRSPRAKTKPARRSS

SEQ ID NO: 6057 - skipped

SEQ ID NO: 6058 - protein, 23 aa, Canis lupus familiaris
PRPARRALSPGPLVARATCWAPW

SEQ ID NO: 6059 - protein, 47 aa, Canis lupus familiaris
PRPASCAGAHCRPAGPASAAAPSAPRCCRAPASWPWEAAGAAARGTR

SEQ ID NO: 6060 - protein, 95 aa, Canis lupus familiaris
PRPATTWPSPGAGRRAWPSPPRIPAAGRSGRRFGRRALARLKLAGALPRPRRRAAPRSRGLRATRARRARRPSCKICPPVPCWPRTGPRRSWEWS

SEQ ID NO: 6061 - skipped

SEQ ID NO: 6062 - protein, 24 aa, Canis lupus familiaris
PRPFPLRLRPTGYCALGTAERRGR

SEQ ID NO: 6063 - skipped

SEQ ID NO: 6064 - protein, 98 aa, Canis lupus familiaris
PRPGCRPRPPRCPSRGPTASSTGPAGRSARGAPSRASGCASRSSRRRRRSGPCPPARPAPRRAPSAAPPSARASPSPRRRPPPTPTPSTRSPGRPSTC

SEQ ID NO: 6065 - protein, 35 aa, Canis lupus familiaris
PRPGGSWRTPPPRSGALPSSAALSWIGSTSRRLAY

SEQ ID NO: 6066 - protein, 39 aa, Canis lupus familiaris
PRPGQVRAGQPQLQRGLGVPDEVLLSFGLRPTGLPFPIP

SEQ ID NO: 6067 - protein, 12 aa, Canis lupus familiaris
PRPGSFCGASGG

SEQ ID NO: 6068 - skipped

SEQ ID NO: 6069 - protein, 37 aa, Canis lupus familiaris
PRPLASTPMRMWPPRSPRPELCLRLCCPCNPRLHPPG

SEQ ID NO: 6070 - protein, 40 aa, Canis lupus familiaris
PRPLLLTRGMFRLHCPARPHLRLLRRRRASRRQWTPESCS

SEQ ID NO: 6071 - protein, 9 aa, Canis lupus familiaris
PRPLLPSPT

SEQ ID NO: 6072 - protein, 26 aa, Canis lupus familiaris
PRPLPCASPAWNTRAARLPPRPRPGA

SEQ ID NO: 6073 - protein, 18 aa, Canis lupus familiaris
PRPLPLRPPRQPAVGGDG

SEQ ID NO: 6074 - protein, 72 aa, Canis lupus familiaris
PRPLPRGCRVGWEAPRARGAGAGAAGCRWPTRCWPSRPPTCRALLAPRPRRAPRSGCRCSGDARPARGRSSG

SEQ ID NO: 6075 - protein, 45 aa, Canis lupus familiaris
PRPLQTGQAPFSSSLVMTTCHHPHRPSPKPESPVKQQGPSSNPPL

SEQ ID NO: 6076 - protein, 37 aa, Canis lupus familiaris
PRPLSQPPSPAAAPPSRSNPGPGPNTLPKAPGPSSPS

SEQ ID NO: 6077 - protein, 16 aa, Canis lupus familiaris
PRPMGLQLRYVLCHRD

SEQ ID NO: 6078 - protein, 21 aa, Canis lupus familiaris
PRPMGPPAPQSSGLSCLGPAP

SEQ ID NO: 6079 - protein, 38 aa, Canis lupus familiaris
PRPPGGPSWRRRSPRATLQSRLATVATAETKRERRGLS

SEQ ID NO: 6080 - protein, 43 aa, Canis lupus familiaris
PRPPPAPPAPPRAPRKGAQSRAPELRACSPAWPRSLLGEPVHS

SEQ ID NO: 6081 - protein, 18 aa, Canis lupus familiaris
PRPPPPPPTTSRCPCRTC

SEQ ID NO: 6082 - protein, 64 aa, Canis lupus familiaris
PRPPPPPPTTTTTTTTRSTRRPGSPWRRWSTRSTTTPKSGGSCSPTSTSSAGRTPAECCACQTA

SEQ ID NO: 6083 - protein, 21 aa, Canis lupus familiaris
PRPPPSLTLGMRNTSCPPPRS

SEQ ID NO: 6084 - protein, 12 aa, Canis lupus familiaris
PRPPPVVPPDRA

SEQ ID NO: 6085 - protein, 48 aa, Canis lupus familiaris
PRPPRTALSSPTPAAPRPTQRRLPGNPTTPQWTSPQPARPPSTTLSSK

SEQ ID NO: 6086 - protein, 39 aa, Canis lupus familiaris
PRPQAPLLWSWPLVLLSTLPLPTLQSWDLCPGRPHSTVW

SEQ ID NO: 6087 - skipped

SEQ ID NO: 6088 - protein, 12 aa, Canis lupus familiaris
PRPQQSLPRSSL

SEQ ID NO: 6089 - protein, 16 aa, Canis lupus familiaris
PRPRATAGSLRALPGL

SEQ ID NO: 6090 - protein, 37 aa, Canis lupus familiaris
PRPREIGCVGRSRQAAAHGALRTAAGSIPGAGLDVQT

SEQ ID NO: 6091-6092 - skipped (2 entries)

SEQ ID NO: 6093 - protein, 46 aa, Canis lupus familiaris
PRPRHPAPPRSAPARPRRAPASPRRARLPAVPARRAGRCMGPSPCR

SEQ ID NO: 6094 - protein, 63 aa, Canis lupus familiaris
PRPRPFAGLPSLARLGPRPRPVGSLERSRVPQPWTHPRSTLRVAFPPATPHSSWAPRLASSAA

SEQ ID NO: 6095 - skipped

SEQ ID NO: 6096 - protein, 12 aa, Canis lupus familiaris
PRPRPPTRTTTP

SEQ ID NO: 6097 - protein, 62 aa, Canis lupus familiaris
PRPRQLQTVTGCLQGLCGEWTRLWPAAGLTLGASWQRATAPWAKETRSLTPAPCRQRRRPGL

SEQ ID NO: 6098 - protein, 39 aa, Canis lupus familiaris
PRPSGAGAAPRDRRSAMPGPGPCAAGAGPRRCWTSAPSE

SEQ ID NO: 6099 - protein, 16 aa, Canis lupus familiaris
PRPSGPLLVWGASFFS

SEQ ID NO: 6100 - protein, 18 aa, Canis lupus familiaris
PRPSGVSMEVALTAQAEN

SEQ ID NO: 6101 - protein, 10 aa, Canis lupus familiaris
PRPSHPGPAA

SEQ ID NO: 6102 - protein, 19 aa, Canis lupus familiaris
PRPSLRISGTCTTSPTRCS

SEQ ID NO: 6103 - skipped

SEQ ID NO: 6104 - protein, 20 aa, Canis lupus familiaris
PRPSRPPRPVRSQGLTMLPT

SEQ ID NO: 6105 - protein, 67 aa, Canis lupus familiaris
PRPSTSWAAPLPRAAAPWPRGPRPSSPSAGPRHAPRPPPTTHPWPSGAPYWARAAALSPRLCALKTT

SEQ ID NO: 6106 - protein, 56 aa, Canis lupus familiaris
PRPTRPWSSRHFASCHRSSSFQSLSSPAWALSWLWSVCPLTSTTLMSVTSRTPSPT

SEQ ID NO: 6107 - protein, 61 aa, Canis lupus familiaris
PRPTTITGSSSSTIPTCPFHTGFTDQSLRSPPTVSDSRPSQVFPEIKAHTSWKKLPCSTRP

SEQ ID NO: 6108 - protein, 33 aa, Canis lupus familiaris
PRPWPPVPSWTFLCSSSTTACGRVSRTCGTWYW

SEQ ID NO: 6109 - protein, 12 aa, Canis lupus familiaris
PRPWRSCPAPAT

SEQ ID NO: 6110 - protein, 57 aa, Canis lupus familiaris
PRPWRSTGWNTGRRRSTRKSGSTACRWVPRCGGGPSAAARKSISSAPQTTPWQQPWL

SEQ ID NO: 6111 - protein, 43 aa, Canis lupus familiaris
PRQAAGTLRLQLPPRSGPRPLARALGPPPLSALPPGKCLRRRP

SEQ ID NO: 6112 - protein, 99 aa, Canis lupus familiaris
PRQADVGGGTGVLPGTGCRDCHHGPALCSLGRGPGPLQPGLAGRWQCALSHCHTQPALRWGPAWCQDALPLPQPDRLSQQAQPLQRVLLPRLCPALRHA

SEQ ID NO: 6113 - protein, 33 aa, Canis lupus familiaris
PRQAGARSRSLRGPWSTCVCRREGRYSWSRWPR

SEQ ID NO: 6114 - protein, 38 aa, Canis lupus familiaris
PRQARSQTSPASPVRTRPPLGGSPRFPNACLPDTPWRG

SEQ ID NO: 6115 - protein, 24 aa, Canis lupus familiaris
PRQHPASSQRPAAMRPTWRSGMTS

SEQ ID NO: 6116 - skipped

SEQ ID NO: 6117 - protein, 15 aa, Canis lupus familiaris
PRQPWLCQVSQRKES

SEQ ID NO: 6118 - protein, 44 aa, Canis lupus familiaris
PRQRHQLQSLVMSTTPSCITCWGPAKGQNRRTSSRMTRSPCPLW

SEQ ID NO: 6119 - protein, 18 aa, Canis lupus familiaris
PRQRWPEPSADYSPEACL

SEQ ID NO: 6120 - protein, 62 aa, Canis lupus familiaris
PRQTLAPSGPRPHPATRLPGSRPPPPRPTVSTTSTTRSPRGPPGRSRGARSRRPWLPWMARD

SEQ ID NO: 6121 - protein, 26 aa, Canis lupus familiaris
PRQVLLSKSTWDHHPILMLNHLTFTS

SEQ ID NO: 6122 - protein, 44 aa, Canis lupus familiaris
PRQVLPPAAHAPAAPALSSPPAQAAVPVRSPGCLLFLRPVFPVG

SEQ ID NO: 6123 - skipped

SEQ ID NO: 6124 - protein, 45 aa, Canis lupus familiaris
PRRALRPRPRRPGTRGSVPPAKMTAGTGRTSGCRTSSARCTTTWR

SEQ ID NO: 6125 - protein, 45 aa, Canis lupus familiaris
PRRAPPSPAPHPPARRPAAAKRTASCCRPTARSSGCLPCPGTWTP

SEQ ID NO: 6126 - protein, 36 aa, Canis lupus familiaris
PRRAPRSPLSCGPRGPRMLLLTAASCGPPGRPEIRS

SEQ ID NO: 6127 - protein, 11 aa, Canis lupus familiaris
PRRASDSASRT

SEQ ID NO: 6128 - protein, 9 aa, Canis lupus familiaris
PRRASTSSH

SEQ ID NO: 6129 - protein, 44 aa, Canis lupus familiaris
PRRAVERARTAPLAAWCPPSGRRAGPGPWTPHPVGATWRREARH

SEQ ID NO: 6130 - protein, 30 aa, Canis lupus familiaris
PRRAVGGAGTSKRSCFHWCSLKWPEFSGFG

SEQ ID NO: 6131 - protein, 68 aa, Canis lupus familiaris
PRRCPWTSAWTTSLRCPWRSPPSGSSSCSRSYWPSSRSSSSRGRSSSPSSRGSTSSSPGSTRPSCTST

SEQ ID NO: 6132-6133 - skipped (2 entries)

SEQ ID NO: 6134 - protein, 71 aa, Canis lupus familiaris
PRRGSLWGLPPRPRGGQPACTRWPAISGAPRSQVPQLPLAQPRPPALYCEQHRPPEDPFSRPGRRGALRWQ

SEQ ID NO: 6135 - skipped

SEQ ID NO: 6136 - protein, 8 aa, Canis lupus familiaris
PRRIALHS

SEQ ID NO: 6137 - protein, 13 aa, Canis lupus familiaris
PRRPCPAAAVSTS

SEQ ID NO: 6138 - protein, 88 aa, Canis lupus familiaris
PRRPCPCAWAAGGSAPGARCAPLCCSSPGSSPSTGTTAPGRDITATSQTPPATSPPSRSTPRAATPGARRPARSSAAPNSCFRSRGPE

SEQ ID NO: 6139 - protein, 35 aa, Canis lupus familiaris
PRRPCSSPCPSRTGFCWGPALPTWPRASWRPEGCR

SEQ ID NO: 6140 - protein, 58 aa, Canis lupus familiaris
PRRPFPSRVREPARPAVSRSSRRAEGHGLHLEKSFAFLLSLFKPLLSEPLEEAWFLLE

SEQ ID NO: 6141 - protein, 32 aa, Canis lupus familiaris
PRRPHPHFLSLSLHPGGPCSFGHLSLPRAKPT

SEQ ID NO: 6142 - protein, 19 aa, Canis lupus familiaris
PRRPPGMWPPPPGHVRPPL

SEQ ID NO: 6143 - protein, 57 aa, Canis lupus familiaris
PRRPPKQPPPQPHRPRQTITITTSSTCSAVAIMVAVVGSTGSSRHKLQPLGTRGTQP

SEQ ID NO: 6144 - protein, 16 aa, Canis lupus familiaris
PRRPPLCPARPRPAST

SEQ ID NO: 6145 - protein, 14 aa, Canis lupus familiaris
PRRPPRRRTGRPAP

SEQ ID NO: 6146 - protein, 80 aa, Canis lupus familiaris
PRRPRPTQTRRPHFPPSPVPADRPRPPLPRDSTRAPPAVGSRPAPSGRRSMPGPPPSPPSPPSPPLPRPALGRLRALRSL

SEQ ID NO: 6147 - protein, 69 aa, Canis lupus familiaris
PRRPRRVPPPPAGLHCHSCPPRRRREPTTASSLCLSPAGDTALPNRGGHRGSSEVPVPSAGCGRGNPAR

SEQ ID NO: 6148 - protein, 11 aa, Canis lupus familiaris
PRRPSLITGSR

SEQ ID NO: 6149 - protein, 38 aa, Canis lupus familiaris
PRRPWRGAETGRDCSPSPGRAEAGVPRRRGSPGPNSNQ

SEQ ID NO: 6150 - protein, 20 aa, Canis lupus familiaris
PRRQPADKAGAPGETPWAVL

SEQ ID NO: 6151 - protein, 33 aa, Canis lupus familiaris
PRRQPMAYPMLCTHKGKKAGGHTPGKPTTCLCL

SEQ ID NO: 6152 - protein, 98 aa, Canis lupus familiaris
PRRQRGLASRRKRRTKLSISARQWERSPMRTCSRKQPNADSSPGPQARSHEEKSGGQMEALTTGLQRPRASPSGTRPSWDGEELSGTAGEAKLDHLRK

SEQ ID NO: 6153 - protein, 58 aa, Canis lupus familiaris
PRRRARPPGLGLRPQHSPPPLAVPVFESSSWTTGAGSPTDAADGRAWNTMSGIQTAAS

SEQ ID NO: 6154 - protein, 29 aa, Canis lupus familiaris
PRRRERGPAAQPRAASSRSPARWACLSPR

SEQ ID NO: 6155 - protein, 13 aa, Canis lupus familiaris
PRRRPPGRWPPGS

SEQ ID NO: 6156 - skipped

SEQ ID NO: 6157 - protein, 16 aa, Canis lupus familiaris
PRRRPPRWRRPCSTGT

SEQ ID NO: 6158 - protein, 73 aa, Canis lupus familiaris
PRRRQQQGGPPGSRAGPWPGRGGRPRRRRRAQRPRRPDPGLRPLLRGSPGPGRGAQGTAVPAEDRVRHEYQKT

SEQ ID NO: 6159 - protein, 73 aa, Canis lupus familiaris
PRRRRHHSRTAPRPTGPRAGLAQGPGLQVAACSTARTRASGRCPPARSPAWGPRVPTPAGPSCRQIISTPVLA

SEQ ID NO: 6160 - protein, 15 aa, Canis lupus familiaris
PRRRRRPTSSRWSGR

SEQ ID NO: 6161 - protein, 20 aa, Canis lupus familiaris
PRRRRRRARRSRPAAPRTAC

SEQ ID NO: 6162 - protein, 48 aa, Canis lupus familiaris
PRRRSPRRPAPWCRLALRTGRKTGRAPRVLDGRCHKSLPEALAGGPPS

SEQ ID NO: 6163 - protein, 31 aa, Canis lupus familiaris
PRRSCGRPRTAGALARASGLSWSTLMGRKWP

SEQ ID NO: 6164 - protein, 61 aa, Canis lupus familiaris
PRRSLPPRNSPDPSSPARPAAATSPRPPPPPLPQWTKQKVAFPRRMTPPRPQGAWPPRLRL

SEQ ID NO: 6165 - protein, 24 aa, Canis lupus familiaris
PRRSRSTQVPCSLFHPCSGQHQRP

SEQ ID NO: 6166 - skipped

SEQ ID NO: 6167 - protein, 47 aa, Canis lupus familiaris
PRRSVRSPCTSSPSDACRKKTSSSEPRLCRPSPTPSPSSAAPGARRC

SEQ ID NO: 6168 - protein, 26 aa, Canis lupus familiaris
PRRTAARGAARARCPWQSPGLGPPRL

SEQ ID NO: 6169 - protein, 19 aa, Canis lupus familiaris
PRRTFPRRSPRPPAAPSTP

SEQ ID NO: 6170 - protein, 72 aa, Canis lupus familiaris
PRRTSPTPPPPASPPRAGLLQPHPRGAHSTTSHSSRPCGLRHPPPRRQTGHPWPPNRPLQNRGPTLRWRLKD

SEQ ID NO: 6171 - protein, 60 aa, Canis lupus familiaris
PRRVRSATYIGWSGLIGTVPALPLTTEGFWKPGRGLVSLFAIPCVNNVNFIGLLREGIPI

SEQ ID NO: 6172 - protein, 10 aa, Canis lupus familiaris
PRRWSLLFAE

SEQ ID NO: 6173 - protein, 48 aa, Canis lupus familiaris
PRSAGSAARASAAAVICCATCWCTPAPGPTRARSVAAASAATPTCCAT

SEQ ID NO: 6174 - protein, 12 aa, Canis lupus familiaris
PRSAPPMATWAT

SEQ ID NO: 6175 - protein, 23 aa, Canis lupus familiaris
PRSARTPALPTTSPPCCPAGTCR

SEQ ID NO: 6176 - protein, 25 aa, Canis lupus familiaris
PRSCQGSCWATGYSTTVPMRQSPTS

SEQ ID NO: 6177 - protein, 93 aa, Canis lupus familiaris
PRSCSARGPPTSSSSSTPTPSLATGRSCARRLSIACPAARGPRCTPSACRPTSCGTLTPTPSTRSAYCSRARVRAAPAARGRPSSAAPNAQNP

SEQ ID NO: 6178 - protein, 22 aa, Canis lupus familiaris
PRSCSLRRAGRPRTVQRQLGTE

SEQ ID NO: 6179 - protein, 34 aa, Canis lupus familiaris
PRSEQHGTAPSTPSAPLLLVLLSKPAALCELSEL

SEQ ID NO: 6180 - protein, 21 aa, Canis lupus familiaris
PRSGRISPRPRWRLRVSSLAP

SEQ ID NO: 6181 - protein, 42 aa, Canis lupus familiaris
PRSGRSRARPSPARRCWSWSGASCARSTWPPPRGQRWPRPCA

SEQ ID NO: 6182 - protein, 31 aa, Canis lupus familiaris
PRSHRTSAAPSASIRPLIWTPCRYTSWSASS

SEQ ID NO: 6183 - protein, 34 aa, Canis lupus familiaris
PRSLAPGSRTHRSPWSGTGRPLCGATPRGSPRPG

SEQ ID NO: 6184 - protein, 16 aa, Canis lupus familiaris
PRSLRCQNLKWCPRWT

SEQ ID NO: 6185 - protein, 9 aa, Canis lupus familiaris
PRSLVLLWR

SEQ ID NO: 6186 - protein, 79 aa, Canis lupus familiaris
PRSPACAPPLQPPSHPLALAALWPPRLCPAVWLAATSGPPQCHPPCPPILPSPPGARAGVHRPPPARPPRGHPHPARSL

SEQ ID NO: 6187 - protein, 17 aa, Canis lupus familiaris
PRSPFGGPTSTCARPQA

SEQ ID NO: 6188 - protein, 23 aa, Canis lupus familiaris
PRSPPRPPSAWSSQPSRPACGRS

SEQ ID NO: 6189 - protein, 14 aa, Canis lupus familiaris
PRSPPSEPATAGAE

SEQ ID NO: 6190 - protein, 78 aa, Canis lupus familiaris
PRSPQAPAAAALHLFPGKAASPSRGKAVGRAGGSRGPAGEAAEARRAGRSPRRPRAVSEPEALLGELSPASSSGSRKS

SEQ ID NO: 6191 - protein, 47 aa, Canis lupus familiaris
PRSPRGARPAEQRGWPAPTCPRRRSRAPRPREARAAPSPRPPTPPGG

SEQ ID NO: 6192 - skipped

SEQ ID NO: 6193 - protein, 20 aa, Canis lupus familiaris
PRSPRRACLSLGPWNRWPIG

SEQ ID NO: 6194 - protein, 58 aa, Canis lupus familiaris
PRSPRRPRSPSGSRPSALPRPPPRDRPPPRATPGRPHWPQTSTRQPCPRPARGTSTCS

SEQ ID NO: 6195 - protein, 46 aa, Canis lupus familiaris
PRSQKGNVWTSMTSTASAWRKICWSCRRSSTCILNSGRKRKRSSLR

SEQ ID NO: 6196 - protein, 13 aa, Canis lupus familiaris
PRSQRFPKPWGLQ

SEQ ID NO: 6197 - protein, 16 aa, Canis lupus familiaris
PRSQSLTTFEFPEHLQ

SEQ ID NO: 6198 - protein, 49 aa, Canis lupus familiaris
PRSRAPPRPPRPPTAARSAGSSAAACRRSGRRPTAGACPWTSTTSPPRS

SEQ ID NO: 6199 - protein, 8 aa, Canis lupus familiaris
PRSRARRP

SEQ ID NO: 6200 - skipped

SEQ ID NO: 6201 - protein, 66 aa, Canis lupus familiaris
PRSRPRWGPGSCPAPGPGPRPCRRPRPRPRRRRPRPRRRRRRRRRPRRPRRCSCPCPWTCRSSRPS

SEQ ID NO: 6202 - protein, 11 aa, Canis lupus familiaris
PRSRPTATSRS

SEQ ID NO: 6203 - protein, 27 aa, Canis lupus familiaris
PRSRRTFPRTLSTTMATSRPPGSPRTR

SEQ ID NO: 6204 - protein, 77 aa, Canis lupus familiaris
PRSRSRCWENVCSHSSKPCIQTWLEKSQACCWRSTTLSCCTCWSPLSLSAPRWMKLWRFYRLIMPRKKLPRRIQKPN

SEQ ID NO: 6205 - protein, 81 aa, Canis lupus familiaris
PRSRSRCWENVCSHSSKPCIQTWLEKSQACCWRSTTLSCCTCWSPLSLSAPRWMKLWRFYRLIMPRKKLPRRWALLLLLPL

SEQ ID NO: 6206 - protein, 25 aa, Canis lupus familiaris
PRSRWSGAAVLAAKRGLSWWHGRGV

SEQ ID NO: 6207 - protein, 21 aa, Canis lupus familiaris
PRSSCSSTRSARPRSACGTQA

SEQ ID NO: 6208 - protein, 21 aa, Canis lupus familiaris
PRSSPRLPHPAPHASTASSPP

SEQ ID NO: 6209 - protein, 25 aa, Canis lupus familiaris
PRSSPRRRGTAPSCCPSWSSRSCAR

SEQ ID NO: 6210 - protein, 39 aa, Canis lupus familiaris
PRSSSAPPVSTAKTIQPLRWKKKRSTARPTCVDWEAWPP

SEQ ID NO: 6211 - protein, 19 aa, Canis lupus familiaris
PRSVWWAVDPLASIPPNTC

SEQ ID NO: 6212 - protein, 10 aa, Canis lupus familiaris
PRSWPCTRTC

SEQ ID NO: 6213 - protein, 46 aa, Canis lupus familiaris
PRSWSSADLEITEETAWSALGTSSSLATSQPFIIPKGRTSHSSPHW

SEQ ID NO: 6214-6215 - skipped (2 entries)

SEQ ID NO: 6216 - protein, 30 aa, Canis lupus familiaris
PRTASPRSTRPLTPTPLRSTRARPPSPSTR

SEQ ID NO: 6217 - protein, 19 aa, Canis lupus familiaris
PRTCLASPKSSCPVPPRCP

SEQ ID NO: 6218 - protein, 10 aa, Canis lupus familiaris
PRTCRSSRSR

SEQ ID NO: 6219 - protein, 20 aa, Canis lupus familiaris
PRTCRSSRSRCRSSRSSWTQ

SEQ ID NO: 6220 - protein, 31 aa, Canis lupus familiaris
PRTGEMRSLEQNLAPGVSPMSPAPPTPQRLS

SEQ ID NO: 6221 - protein, 19 aa, Canis lupus familiaris
PRTGQLGCADCPWDALPAL

SEQ ID NO: 6222 - protein, 8 aa, Canis lupus familiaris
PRTGTLSS

SEQ ID NO: 6223 - protein, 39 aa, Canis lupus familiaris
PRTHPWSSGVTVNITAWTSVGRNLETYTILTVAPRPTLK

SEQ ID NO: 6224 - skipped

SEQ ID NO: 6225 - protein, 11 aa, Canis lupus familiaris
PRTLGCGHVQG

SEQ ID NO: 6226 - protein, 73 aa, Canis lupus familiaris
PRTLRAPHPGPSAPSKTPTSLGAPCLVTWSSPACRPPPGTGSTCRCWCAPTSREDSCSSRPPSQMAAPPWSSS

SEQ ID NO: 6227 - protein, 64 aa, Canis lupus familiaris
PRTNWEASSEPPSSLASGWASRHPRRRPAPVTRPPCRWPRIAAPWAPRPRRQTLPAPRARTSAL

SEQ ID NO: 6228 - protein, 53 aa, Canis lupus familiaris
PRTNWLPLMELGKNTPSVLQTTNSPHQQAKSVTALLLPTLHHVTTSSRERERC

SEQ ID NO: 6229 - protein, 53 aa, Canis lupus familiaris
PRTPGSTAAPCSCCRPAPRTTSPAEPSTPSRPPPSSGSGTGRSRRAPWPARNC

SEQ ID NO: 6230 - protein, 47 aa, Canis lupus familiaris
PRTPVRLPGRVLRPSLLPLRRAHAPHPHPHRPEALPVSHLHAQLQPQ

SEQ ID NO: 6231 - protein, 12 aa, Canis lupus familiaris
PRTPWSMSRPPS

SEQ ID NO: 6232 - protein, 16 aa, Canis lupus familiaris
PRTRLCLTPWYTRQSR

SEQ ID NO: 6233 - protein, 34 aa, Canis lupus familiaris
PRTRPWPGLAPGNAAAPKPAAPPQIAPARRPPRR

SEQ ID NO: 6234 - protein, 80 aa, Canis lupus familiaris
PRTTTRLSSGSTTLQASSTMRAKASWRRTGTPCMETSSSWSTPPETSSSSRSSRLMSPWAPRQGSARPHSAASSSGPWSC

SEQ ID NO: 6235 - protein, 16 aa, Canis lupus familiaris
PRTVKVMRTTWSSWRC

SEQ ID NO: 6236 - protein, 35 aa, Canis lupus familiaris
PRTWALPPGLCPFPSPATTLRGSVSATLSSGSLLT

SEQ ID NO: 6237 - skipped

SEQ ID NO: 6238 - protein, 69 aa, Canis lupus familiaris
PRVCQSPVYGGSMQEPGYPPMAESSKRAMNWCLLVPPRVMLVSTPAMQPTWLVSGDKMSISLWPLCPHG

SEQ ID NO: 6239 - protein, 22 aa, Canis lupus familiaris
PRVLALAAGPSTPAWLPPGVPA

SEQ ID NO: 6240 - protein, 44 aa, Canis lupus familiaris
PRVLLHQPGVGPYRFGFPLCWPRFSLRWPPVQLSVPGTGPGLSS

SEQ ID NO: 6241 - protein, 20 aa, Canis lupus familiaris
PRVRRTASRPRRRSGFRRQS

SEQ ID NO: 6242 - protein, 37 aa, Canis lupus familiaris
PRVSGGGPWGGSRSADREGGRFFLGAGLCPARRQQGF

SEQ ID NO: 6243 - protein, 69 aa, Canis lupus familiaris
PRWARGGRGKNWTQRTPRHAAVWPWGSPLPMALPLLAFPGLHPLGLACIRHHPARPPHLALGRASLPGQ

SEQ ID NO: 6244 - protein, 14 aa, Canis lupus familiaris
PRWEPVWALLGSMR

SEQ ID NO: 6245 - protein, 44 aa, Canis lupus familiaris
PRWHSRFPRLSLHPSGDLHVHDQTSPVLLSGNHAGETSLCHSLP

SEQ ID NO: 6246 - protein, 18 aa, Canis lupus familiaris
PRWKEPTANPSRNLLKPV

SEQ ID NO: 6247 - protein, 39 aa, Canis lupus familiaris
PRWLVQSPVSLPSGAQVHPRGHAVLMWDRLLHTQARNQQ

SEQ ID NO: 6248 - protein, 29 aa, Canis lupus familiaris
PRWLVQVHPRGHAVLMWDRLLHTQARNQQ

SEQ ID NO: 6249 - protein, 60 aa, Canis lupus familiaris
PRWPATSLSLGTSWCLTLTSEMGHRAPSCRMAPSVRQSLLRTGHAVGLGVKGAQRSRSHR

SEQ ID NO: 6250 - protein, 11 aa, Canis lupus familiaris
PRWPDLTPGLQ

SEQ ID NO: 6251 - protein, 41 aa, Canis lupus familiaris
PRWPSSATPQKEPPRPLHGWAKGSSMTPGVSASKGRPPCLG

SEQ ID NO: 6252 - protein, 10 aa, Canis lupus familiaris
PRWPTPTRTR

SEQ ID NO: 6253 - protein, 30 aa, Canis lupus familiaris
PRYAASRLPVAAPARVLLGPVGWHVRTAPH

SEQ ID NO: 6254 - protein, 53 aa, Canis lupus familiaris
PSAAASSPAPSALQPPAWGSCSEQWPPAWNSPSHTAQPGRACLRPGLWATCLL

SEQ ID NO: 6255 - protein, 38 aa, Canis lupus familiaris
PSAAQRGTRMSSLTSSSWATSNSWPLTGTIFLTLPKIW

SEQ ID NO: 6256 - protein, 36 aa, Canis lupus familiaris
PSAASLKSCTTTPAASCPSRGPSTCPCSTLWPFGLC

SEQ ID NO: 6257 - protein, 29 aa, Canis lupus familiaris
PSACHWWVLMTCARCRRRKPESCSRRGRS

SEQ ID NO: 6258 - protein, 13 aa, Canis lupus familiaris
PSAFTELFPPGGF

SEQ ID NO: 6259 - protein, 23 aa, Canis lupus familiaris
PSAGKFSGFQNHLGTRRPEAQQL

SEQ ID NO: 6260 - protein, 9 aa, Canis lupus familiaris
PSAHPPHTS

SEQ ID NO: 6261 - protein, 9 aa, Canis lupus familiaris
PSAKVPCVH

SEQ ID NO: 6262 - protein, 15 aa, Canis lupus familiaris
PSALFERYRFNHSSR

SEQ ID NO: 6263 - protein, 56 aa, Canis lupus familiaris
PSALGSDPPPSFSLAPAPAPAPAPAPVQPLLFGDESGSGWRIFGTVCLQCSQRCNQ

SEQ ID NO: 6264 - protein, 61 aa, Canis lupus familiaris
PSALGVPERGGRDEPARCPADHSRPGRWGHPAPDAHPHHPRQPPGRLRQPDFHHQFGYYMH

SEQ ID NO: 6265 - protein, 71 aa, Canis lupus familiaris
PSALPWPLCCGTSGGLWPCSWTTTLLVTLAWSSCCRASVSARLFTCEITISQTEASVSSSSMLCTASSCRS

SEQ ID NO: 6266 - protein, 75 aa, Canis lupus familiaris
PSALRISGLRDPHSPGEEEQQAGHPGQDLQTLEMEEEEKRKTEADDVRAGEEDDRQARSGGAHQEGSAGDDGAGC

SEQ ID NO: 6267 - protein, 63 aa, Canis lupus familiaris
PSALRLSTAPFLTRAAPMKLWVRCSPSSPRMTSSRCSTRCPSTRACSQISLTSSTCRKAPSPR

SEQ ID NO: 6268 - protein, 37 aa, Canis lupus familiaris
PSAPRCSRTARALLRSIGVEAKGELGWQQRFRAVGGE

SEQ ID NO: 6269 - protein, 8 aa, Canis lupus familiaris
PSAPTMRR

SEQ ID NO: 6270 - protein, 17 aa, Canis lupus familiaris
PSARAAGLPRDAGTAAA

SEQ ID NO: 6271 - protein, 10 aa, Canis lupus familiaris
PSARGRCRST

SEQ ID NO: 6272 - protein, 14 aa, Canis lupus familiaris
PSARTNTSQPQPLR

SEQ ID NO: 6273 - protein, 24 aa, Canis lupus familiaris
PSASGTWRTTSAPGSGRTRPWMWT

SEQ ID NO: 6274 - protein, 16 aa, Canis lupus familiaris
PSASPKPAAWSLLPTL

SEQ ID NO: 6275 - protein, 18 aa, Canis lupus familiaris
PSATGRSCGTKSHPRTSR

SEQ ID NO: 6276 - protein, 73 aa, Canis lupus familiaris
PSAVLRNRLCQARTAAVCPVLYTHPTPVQRAQCTTSSRSSASKAAAPPGLCTSPTARATVETAPPGTPWRPRP

SEQ ID NO: 6277 - protein, 55 aa, Canis lupus familiaris
PSAYPRTTSASRIPWCRSNRTSSHWAVSSTASRGPAWMRSPRACSPLTSSPGRCS

SEQ ID NO: 6278 - protein, 30 aa, Canis lupus familiaris
PSCACWAVACWPWSPCWRGSHLCPPCATLG

SEQ ID NO: 6279 - protein, 69 aa, Canis lupus familiaris
PSCLRASTSSLWWKRRGQAPWWAGCGPRTQTWGTMPSWHIASWTERGLKPSASAQTPRVEMGSSLSARP

SEQ ID NO: 6280 - protein, 34 aa, Canis lupus familiaris
PSCQFLLHCQNAVTLCSMLESPSFSLNLHPLLTL

SEQ ID NO: 6281 - skipped

SEQ ID NO: 6282 - protein, 40 aa, Canis lupus familiaris
PSCRGNERMAPTWLSCSACHSLQAASSASACWTRCFTSPL

SEQ ID NO: 6283 - protein, 12 aa, Canis lupus familiaris
PSCRPAAPQSPC

SEQ ID NO: 6284 - protein, 26 aa, Canis lupus familiaris
PSCTHHLPSPGPHSFPRELRCQVRCC

SEQ ID NO: 6285 - protein, 47 aa, Canis lupus familiaris
PSCTHHLPSPGPHSFPRELRCQWQNERETERATCFEKNGSEPISLWK

SEQ ID NO: 6286 - protein, 17 aa, Canis lupus familiaris
PSDGASMHLDLCQDERI

SEQ ID NO: 6287 - protein, 21 aa, Canis lupus familiaris
PSEIHCSSQPVPVSLPVTEIL

SEQ ID NO: 6288 - protein, 20 aa, Canis lupus familiaris
PSERDTTRARGRVSRPQRGD

SEQ ID NO: 6289 - protein, 12 aa, Canis lupus familiaris
PSERILCSYYFF

SEQ ID NO: 6290 - protein, 25 aa, Canis lupus familiaris
PSESRPRPPDEDEGDSYDPSRVERV

SEQ ID NO: 6291 - skipped

SEQ ID NO: 6292 - protein, 16 aa, Canis lupus familiaris
PSFILHCWEMGSTLLV

SEQ ID NO: 6293 - protein, 58 aa, Canis lupus familiaris
PSFREGTVNKEERTARPCPAWKVALASHLLKVPPVTALTLIWETGVKWKQGAAQKDTV

SEQ ID NO: 6294 - protein, 80 aa, Canis lupus familiaris
PSGAASPWPRSCLPSTTSPYTPATMSTSHPSCLTPLWNAPTLLVPTCKSERAHTRLKVETRPLTALPPPPVPLQRKANTS

SEQ ID NO: 6295 - protein, 16 aa, Canis lupus familiaris
PSGDLGGTRCPPKVKS

SEQ ID NO: 6296 - protein, 54 aa, Canis lupus familiaris
PSGEQRGPSPRSRGLPGAGGGRPYSALQPARRTPGAESGGPRGRFWRAPTSQRP

SEQ ID NO: 6297 - protein, 9 aa, Canis lupus familiaris
PSGGDFPGL

SEQ ID NO: 6298 - protein, 45 aa, Canis lupus familiaris
PSGGGLGCKVPGGGRGAGCSVLPSSVSHPGCGGRWGPGRGRGAER

SEQ ID NO: 6299 - protein, 10 aa, Canis lupus familiaris
PSGHLGSLAL

SEQ ID NO: 6300 - protein, 28 aa, Canis lupus familiaris
PSGILTTPEHFTFFARTRNLLWRVYRFQ

SEQ ID NO: 6301 - protein, 92 aa, Canis lupus familiaris
PSGRAAVPCAPAPSGRARCGPTRRGRTRGPCPPCPAPRPSAARRAHGPSAATRSHGAAAARPRAPASPQGLRPRRPRTSAVCAGRASARAPH

SEQ ID NO: 6302 - protein, 26 aa, Canis lupus familiaris
PSGRRAGPGPWTPHPVGATWRREARH

SEQ ID NO: 6303 - protein, 9 aa, Canis lupus familiaris
PSGSQQDPG

SEQ ID NO: 6304 - protein, 49 aa, Canis lupus familiaris
PSGTAKPWWHCQRFCWLNIALCQQAPLKRGPLRASCRCPSQRGALWAGA

SEQ ID NO: 6305 - protein, 20 aa, Canis lupus familiaris
PSGTDSSLRPPAPPGATCGA

SEQ ID NO: 6306 - protein, 8 aa, Canis lupus familiaris
PSGVHLCR

SEQ ID NO: 6307-6309 - skipped (3 entries)

SEQ ID NO: 6310 - protein, 11 aa, Canis lupus familiaris
PSHKPPLGLGA

SEQ ID NO: 6311 - protein, 23 aa, Canis lupus familiaris
PSHPPSEGRSPFLLAQSRRRSQS

SEQ ID NO: 6312 - protein, 18 aa, Canis lupus familiaris
PSHPPSTPAQEPCLRDRL

SEQ ID NO: 6313 - protein, 43 aa, Canis lupus familiaris
PSHPQDSPASLTHPWKMVPLVARAPPASASVTLWYPREAHGEP

SEQ ID NO: 6314 - protein, 16 aa, Canis lupus familiaris
PSHSPCQGAWANMMTT

SEQ ID NO: 6315 - protein, 87 aa, Canis lupus familiaris
PSHSRHPSSSTSPRHGLCTCSPCSSLPTSSSPRRPRASSPRTRPRASSRRLHSPPSLSRSSSITLHPGTTSRTPILPVTSEKPPPRL

SEQ ID NO: 6316 - skipped

SEQ ID NO: 6317 - protein, 18 aa, Canis lupus familiaris
PSIASQAEAKAGRACSPL

SEQ ID NO: 6318 - protein, 14 aa, Canis lupus familiaris
PSIESTSFSSMETS

SEQ ID NO: 6319 - protein, 32 aa, Canis lupus familiaris
PSIFNIWIILANVSMLMTVLSYPWALMNSWPL

SEQ ID NO: 6320 - protein, 38 aa, Canis lupus familiaris
PSIPIPPGFHLRWWSRIPAASVRLPTCLPVNSAPSKPG

SEQ ID NO: 6321 - protein, 34 aa, Canis lupus familiaris
PSIPSPLSLPHPRPPPTAQIPALKAATRPSACRA

SEQ ID NO: 6322 - protein, 13 aa, Canis lupus familiaris
PSIQHLQALSPSL

SEQ ID NO: 6323 - protein, 13 aa, Canis lupus familiaris
PSISAQGRRPCPV

SEQ ID NO: 6324 - protein, 32 aa, Canis lupus familiaris
PSISSVRSTGPTQAALQPAFESWRSVVGTGDQ

SEQ ID NO: 6325 - protein, 58 aa, Canis lupus familiaris
PSIWSWGFGASGRWWSARPMQLISTTPRTLRRPSGTFLASALTTALPSILTATLPFPY

SEQ ID NO: 6326 - protein, 35 aa, Canis lupus familiaris
PSKDSLHSSCLHTHPLFPRDPRPGCLHTSQASSSS

SEQ ID NO: 6327 - protein, 43 aa, Canis lupus familiaris
PSLAFDSWLPSAYCSSHGSTVPVCGGPPGFKTFSQLGSSWPWP

SEQ ID NO: 6328 - protein, 45 aa, Canis lupus familiaris
PSLAGPGTSQRACSAHVGSTTTHSSQKSTMSPSSSTCSWSTSPSP

SEQ ID NO: 6329 - protein, 55 aa, Canis lupus familiaris
PSLAGPVSCLTPLWCSGTSQRACSAHVGSTTTHSSQKSTMSPSSSTCSWSTSPSP

SEQ ID NO: 6330 - protein, 75 aa, Canis lupus familiaris
PSLAPRLSAWTPRSAPTCWRPTRRPAPPGCRPCAETPFRKAAGLWRLRKTHPSFLPWRCWRTRCIVPPGKDPSSG

SEQ ID NO: 6331 - skipped

SEQ ID NO: 6332 - protein, 45 aa, Canis lupus familiaris
PSLEQRRTLILVPSSTSLPVCPTYGTSSASCSVPLWSLCARPQAI

SEQ ID NO: 6333 - protein, 73 aa, Canis lupus familiaris
PSLGQIPASRLPWQRATATLIWTLPSWIASSPGLKLLPAPWPLPQPCPRYPQPWALSRPPQPQRSFIRSPESA

SEQ ID NO: 6334 - protein, 87 aa, Canis lupus familiaris
PSLGRAASGPLRPPSADQPRPGAAAALPRLFLRSRARGHPLLGGPHAGQAAQRRGEDPPLRLPAALAVVSGRAAPAPEVPRGARRPR

SEQ ID NO: 6335 - protein, 18 aa, Canis lupus familiaris
PSLHLDFLRHPRPKTIAL

SEQ ID NO: 6336 - protein, 39 aa, Canis lupus familiaris
PSLIPVSITRFPASFLVVRKCLCQQFLCSLKNSKVKKCC

SEQ ID NO: 6337 - protein, 61 aa, Canis lupus familiaris
PSLLCNPPLLPPSPRSSPSRASSAARRSNFRATSWCTGAATRARSPTSATCATTRARRPAS

SEQ ID NO: 6338 - protein, 21 aa, Canis lupus familiaris
PSLLHPHLHPLLSPPSCPLRS

SEQ ID NO: 6339 - skipped

SEQ ID NO: 6340 - protein, 49 aa, Canis lupus familiaris
PSLPAPPPRVPAHSSADLSPLLPSHTPCPPGPPRAPGPASFLGHQVCPL

SEQ ID NO: 6341 - protein, 24 aa, Canis lupus familiaris
PSLQAPDPNEAHPHQRDGLLALQG

SEQ ID NO: 6342 - protein, 45 aa, Canis lupus familiaris
PSLRRGGLPASPPASPRLSVPASQVAERPGGRTEMRVPPARRGPR

SEQ ID NO: 6343 - protein, 100 aa, Canis lupus familiaris
PSLRSPMVAVAAVRWESTLACRMKGTGSHSWTVAPCGAPGLCRCQTRYGPPTSSSHSHSRPSPLHRGLLHRATLSTCSRWAATWHVGIFPCSSMVSHSRG

SEQ ID NO: 6344 - protein, 8 aa, Canis lupus familiaris
PSLRVATV

SEQ ID NO: 6345 - protein, 28 aa, Canis lupus familiaris
PSLSLPVATPSPHSPCWSPGVSGGCRSV

SEQ ID NO: 6346 - protein, 27 aa, Canis lupus familiaris
PSLSSRVDCCHATASTPSHRPSSGPLF

SEQ ID NO: 6347 - protein, 17 aa, Canis lupus familiaris
PSLWWVPVSQPDRVKSL

SEQ ID NO: 6348 - skipped

SEQ ID NO: 6349 - protein, 14 aa, Canis lupus familiaris
PSMTRMMPNSLNRF

SEQ ID NO: 6350 - protein, 12 aa, Canis lupus familiaris
PSNAVSPQTVHD

SEQ ID NO: 6351 - protein, 27 aa, Canis lupus familiaris
PSNPHRSSMPANRSVPRSSTKGSLIVW

SEQ ID NO: 6352 - skipped

SEQ ID NO: 6353 - protein, 70 aa, Canis lupus familiaris
PSNSSGGGASNPAAKGRPRGSRPVQELEDTGVHRPAEARGQPGGPSPVSGAGGPSRTKGKAKFKECCSGS

SEQ ID NO: 6354 - protein, 90 aa, Canis lupus familiaris
PSNWPCLLEMAHQRWKWCPSSKCGDAATAGHWRSWWTSCRSTRMRWSTCSTHPASPCCAVVAAAETKTCTVCRWRRPMSPCSPTRHRGRT

SEQ ID NO: 6355 - protein, 83 aa, Canis lupus familiaris
PSNWPCLLEMAHQRWKWCPSSKCGDAATAGHWRSWWTSCRSTRMRWSTCSTHPASPCCAVVAAAETKTCTVCRWRRPMSPCSS

SEQ ID NO: 6356 - protein, 12 aa, Canis lupus familiaris
PSPAARPSSSSS

SEQ ID NO: 6357 - protein, 48 aa, Canis lupus familiaris
PSPACPDSAQVSSPPYPGLPHQPPVGSGRQQLYTVWQCQQRRVLPERE

SEQ ID NO: 6358 - protein, 23 aa, Canis lupus familiaris
PSPACRGKQGRDPRRTLTGSRSP

SEQ ID NO: 6359 - protein, 34 aa, Canis lupus familiaris
PSPAGPPPAVGPREKLCTLSPAPGCTSRRMTSEF

SEQ ID NO: 6360 - protein, 22 aa, Canis lupus familiaris
PSPAHLHAAQQDPRRQCRLPGV

SEQ ID NO: 6361 - protein, 26 aa, Canis lupus familiaris
PSPAPGPPAATTIYTPACILPSLSTL

SEQ ID NO: 6362 - protein, 50 aa, Canis lupus familiaris
PSPARTARRTGRRGIPRLPRALRAPGGGRLCGSTSTCRPWTTPRPCASTA

SEQ ID NO: 6363 - protein, 55 aa, Canis lupus familiaris
PSPASTSLALSVKTNLQATTMGSAPVRAARASSAAASRRTWCTRVTGTRTVSSIR

SEQ ID NO: 6364 - protein, 14 aa, Canis lupus familiaris
PSPATPCRSPAPKA

SEQ ID NO: 6365 - protein, 14 aa, Canis lupus familiaris
PSPDRKWGAPLWTV

SEQ ID NO: 6366 - skipped

SEQ ID NO: 6367 - protein, 35 aa, Canis lupus familiaris
PSPGAAPPSQRHPQTQWFSPLSHPSNLAQASWTRC

SEQ ID NO: 6368 - protein, 36 aa, Canis lupus familiaris
PSPGAAPPSQRHPQTQWQVLLHSPGAPDPLHLRLPG

SEQ ID NO: 6369 - protein, 48 aa, Canis lupus familiaris
PSPGREMPRAPSSWREAAEGRGPLLPAASGAGRRGGGRAGAGEGPPPL

SEQ ID NO: 6370 - protein, 67 aa, Canis lupus familiaris
PSPGRPRASGPPFPNSAYAEAGGAPGGTAQEPGGTPGPTEAICSACTPIPVPAGPAHPKPGCLPSLP

SEQ ID NO: 6371 - skipped

SEQ ID NO: 6372 - protein, 41 aa, Canis lupus familiaris
PSPHHGNSSPSNLPLSLSVLARIASESCPPKETSFRFRGHN

SEQ ID NO: 6373 - protein, 14 aa, Canis lupus familiaris
PSPITCTSSTEMRV

SEQ ID NO: 6374 - protein, 38 aa, Canis lupus familiaris
PSPLPRTCCTANSLSSGSPGSSTSTQTWILTRLTLQEA

SEQ ID NO: 6375 - protein, 22 aa, Canis lupus familiaris
PSPLTPRCPPWCPRPPSWCPTL

SEQ ID NO: 6376 - protein, 42 aa, Canis lupus familiaris
PSPMSPQPQRLQSLLNWLLQGRGSPGRLTSCCQAVLASPPWM

SEQ ID NO: 6377 - protein, 30 aa, Canis lupus familiaris
PSPPSTPTLPCPCWGTWSRRCGAGSTAGAV

SEQ ID NO: 6378 - protein, 49 aa, Canis lupus familiaris
PSPPTAAQVSGTAQPASSSTRLMWGWPIASTMLPHHTPSLSWRRWQSTR

SEQ ID NO: 6379 - protein, 16 aa, Canis lupus familiaris
PSPPTPPDASFPASIS

SEQ ID NO: 6380 - protein, 21 aa, Canis lupus familiaris
PSPRALCSGAQGSPGAQDLCY

SEQ ID NO: 6381 - protein, 54 aa, Canis lupus familiaris
PSPRGPSFAPRSQPEPGQPGAVERVQFCGNRDDHHQSWEAHVPCLSSVSHWPGP

SEQ ID NO: 6382 - skipped

SEQ ID NO: 6383 - protein, 21 aa, Canis lupus familiaris
PSPSAAAKRSRRRTQGGRLSS

SEQ ID NO: 6384 - protein, 12 aa, Canis lupus familiaris
PSPSAARLGHQD

SEQ ID NO: 6385 - protein, 35 aa, Canis lupus familiaris
PSPSAPASVGAPGLKAHPKTQRRWTQRPPQRPSPF

SEQ ID NO: 6386 - protein, 9 aa, Canis lupus familiaris
PSPSKMLSA

SEQ ID NO: 6387 - protein, 38 aa, Canis lupus familiaris
PSPSLSLRPLRSRARLWAWPLRPEQVRTGFPSEALLGT

SEQ ID NO: 6388 - skipped

SEQ ID NO: 6389 - protein, 30 aa, Canis lupus familiaris
PSPSPGPKRIQTWGPGLLAPHPRLLSLPRS

SEQ ID NO: 6390 - protein, 14 aa, Canis lupus familiaris
PSPSPGPKRIQTWS

SEQ ID NO: 6391 - protein, 33 aa, Canis lupus familiaris
PSPSPSFHPSPSHSPRLNRLPQPPSLPHRLGPL

SEQ ID NO: 6392 - protein, 24 aa, Canis lupus familiaris
PSPSRPRSPRVRPLVSKRCSRSSL

SEQ ID NO: 6393 - protein, 23 aa, Canis lupus familiaris
PSPSSPPGPRQAARWCSGTSRPF

SEQ ID NO: 6394 - protein, 16 aa, Canis lupus familiaris
PSPSSSAASSPTGSRW

SEQ ID NO: 6395 - protein, 30 aa, Canis lupus familiaris
PSPSVPFTSPRTQWGAGAIVLPQCRAPDWA

SEQ ID NO: 6396 - protein, 50 aa, Canis lupus familiaris
PSPTPPSSAGPSWRLLRSSGHSMRSTTGSHACLPSSGTTLPPGRMPSATI

SEQ ID NO: 6397 - protein, 95 aa, Canis lupus familiaris
PSPTTPCPMDSPLCSHLGETAPPMRRRQAPTPSTDMESVSGQAVRPCVKTWASLSNTSTQSTPWMTGAQPSAGCRCRWYSSWRSSSPRRVRGCRP

SEQ ID NO: 6398 - protein, 20 aa, Canis lupus familiaris
PSPVPSPVLLNAHLPAHPQS

SEQ ID NO: 6399 - protein, 19 aa, Canis lupus familiaris
PSQEDHVLVSLQGAGKDAG

SEQ ID NO: 6400 - protein, 15 aa, Canis lupus familiaris
PSQEEPPGGDPILYP

SEQ ID NO: 6401 - protein, 18 aa, Canis lupus familiaris
PSQEEPPGGDPILYPKGL

SEQ ID NO: 6402 - protein, 35 aa, Canis lupus familiaris
PSQGHWAVRPLLLPPPFSLAAPQPPPACLPLRTGS

SEQ ID NO: 6403 - protein, 42 aa, Canis lupus familiaris
PSQGRAEPTPGPHPPRMVHSPGRGQSPGPEGRRSRLDSGARM

SEQ ID NO: 6404 - protein, 12 aa, Canis lupus familiaris
PSQGRSPRWHRG

SEQ ID NO: 6405 - protein, 8 aa, Canis lupus familiaris
PSQGVPPM

SEQ ID NO: 6406 - protein, 30 aa, Canis lupus familiaris
PSQMCTGCSMTIGMNLLSLASRALSECSRN

SEQ ID NO: 6407 - protein, 79 aa, Canis lupus familiaris
PSQPAFRCPSAAFSAGWPARARSLTPHRPFPRGPTLHLRDTGRPSAPHPSGPWPPQAPTTARCLPGPSSQPPPTALQCW

SEQ ID NO: 6408 - protein, 8 aa, Canis lupus familiaris
PSQRAPRL

SEQ ID NO: 6409 - protein, 89 aa, Canis lupus familiaris
PSQRRKPYCGSWLPCWRKRLKSSTRSWPRTPPCVGSWPASPPAPSPAWWSCSLAGRTALCPAVHAPPCPAQGLHRLPRSPWPAWPWPWS

SEQ ID NO: 6410 - protein, 51 aa, Canis lupus familiaris
PSQRTAPPPGTDAPHLEHLQPPRLLPLPPGPGGGGGRRLRAGILASPAGRR

SEQ ID NO: 6411 - skipped

SEQ ID NO: 6412 - protein, 41 aa, Canis lupus familiaris
PSRISICPRKMESKQGTILMKLLQALLQHPWRAGTRRNWRS

SEQ ID NO: 6413 - protein, 15 aa, Canis lupus familiaris
PSRLEPYPPRYHPYD

SEQ ID NO: 6414 - protein, 34 aa, Canis lupus familiaris
PSRLPPLLPPSPNMSLSCRAPSPRHSHQAARNNM

SEQ ID NO: 6415 - protein, 29 aa, Canis lupus familiaris
PSRLSPRRCASSIARSSLGSPSETASSST

SEQ ID NO: 6416 - protein, 14 aa, Canis lupus familiaris
PSRLSRICPRPNSC

SEQ ID NO: 6417 - protein, 29 aa, Canis lupus familiaris
PSRLTPPILQKKLSHPRKVKSPIPRKKTS

SEQ ID NO: 6418 - protein, 22 aa, Canis lupus familiaris
PSRNLVNPSWGLPFGRRLLQSP

SEQ ID NO: 6419 - protein, 9 aa, Canis lupus familiaris
PSRPCSSQE

SEQ ID NO: 6420 - skipped

SEQ ID NO: 6421 - protein, 17 aa, Canis lupus familiaris
PSRRAMRSQRTSSSGKT

SEQ ID NO: 6422 - protein, 18 aa, Canis lupus familiaris
PSRRPAASSSCTPCTPWA

SEQ ID NO: 6423 - protein, 79 aa, Canis lupus familiaris
PSRRQPPRRRRHHSRTAPRPTGPRAGLAQGPGLQVAACSTARTRASGRCPPARSPAWGPRVPTPAGPSCRQIISTPVLA

SEQ ID NO: 6424 - protein, 44 aa, Canis lupus familiaris
PSRRRPGQALELPAPPGSPPCAGPQSPAPSPDPARRRARRWTWT

SEQ ID NO: 6425 - protein, 74 aa, Canis lupus familiaris
PSRRRRCRPSRRPRPSQCWSSGAIATKVTGSGLCGAASSVGTCTAIPGLPWTSSSRSPPPGPTTFSWAAGTAHA

SEQ ID NO: 6426 - protein, 21 aa, Canis lupus familiaris
PSRSGAPPGEEGESAAGPRCS

SEQ ID NO: 6427 - protein, 47 aa, Canis lupus familiaris
PSRSTSSYLATADAGPCCSRSPRSMTWCCCLTWRKSGRCWWKTFGGP

SEQ ID NO: 6428 - protein, 59 aa, Canis lupus familiaris
PSRSTSYCPATVDAIPCYSRSPRSMTWCCCLTLRKSGAPLCSICRTSVCSGLWALTWLR

SEQ ID NO: 6429 - protein, 18 aa, Canis lupus familiaris
PSRWPAASSSYTPCTPWA

SEQ ID NO: 6430 - skipped

SEQ ID NO: 6431 - protein, 47 aa, Canis lupus familiaris
PSSCQQRHGRGDDPHGPRGQGAQGPQLEGREGHHGQGGRFPGLPHQL

SEQ ID NO: 6432 - skipped

SEQ ID NO: 6433 - protein, 19 aa, Canis lupus familiaris
PSSDPQLRSPAPIWAPPSP

SEQ ID NO: 6434 - protein, 8 aa, Canis lupus familiaris
PSSGGSAP

SEQ ID NO: 6435 - protein, 38 aa, Canis lupus familiaris
PSSHSSHRRPPHRHHSPSPSSHSLRPHRSSSPRCHSAV

SEQ ID NO: 6436 - protein, 75 aa, Canis lupus familiaris
PSSKKAPQPHTGSQGPQRRGSWSGAQTLSGAAGATSVRISTAAPPSRSRRRGPERSRPPPQRPRPLQNRPCWSAG

SEQ ID NO: 6437 - skipped

SEQ ID NO: 6438 - protein, 34 aa, Canis lupus familiaris
PSSLAPTSSSEPRAGKQNPSAGVTSTTATSSSNS

SEQ ID NO: 6439 - protein, 24 aa, Canis lupus familiaris
PSSLEPVPYCWLCLLPCLFQNIPI

SEQ ID NO: 6440 - protein, 59 aa, Canis lupus familiaris
PSSLHPLLLHPLLILHTWLPCPLLILPTSGHTSSHRALMGRLPPSTPHLLRHPPTFMTL

SEQ ID NO: 6441 - skipped

SEQ ID NO: 6442 - protein, 9 aa, Canis lupus familiaris
PSSLRLQQE

SEQ ID NO: 6443 - protein, 71 aa, Canis lupus familiaris
PSSLTWVDPAVPSSFRSRIAYGFFRSHCCWGHLSRSCHPFLWSSCLLCPGFLHLSLCAATLPWPVRLSYHP

SEQ ID NO: 6444 - protein, 36 aa, Canis lupus familiaris
PSSNPRGGKSASPRQPRPQHEHSFHSQQCCQGLCLV

SEQ ID NO: 6445 - protein, 63 aa, Canis lupus familiaris
PSSPASTGCLGSSFSSALRTPVCSRNAWSKPMPCARTQRLCCCTICTWTACPPRAASSSVSRA

SEQ ID NO: 6446 - protein, 44 aa, Canis lupus familiaris
PSSPNRNVWSVSSVLQGALSPSWWPTSFASSRSPRSATPPQPPT

SEQ ID NO: 6447 - protein, 91 aa, Canis lupus familiaris
PSSPPDQPTSSPASQHAAAPATRHAAAPWEPAPHAGPVCLTLTDHAAGIYSSTRLSDYNQSYIHSCTSGNPSNGVCAFWVQKPSRPAGGLE

SEQ ID NO: 6448 - protein, 9 aa, Canis lupus familiaris
PSSPRMISG

SEQ ID NO: 6449 - protein, 17 aa, Canis lupus familiaris
PSSPRPSCSWCGRPCRT

SEQ ID NO: 6450 - protein, 50 aa, Canis lupus familiaris
PSSPSWAPYVSASGVGAPGPVRAQTATVINPQKTPQWTYQPMASAAEISQ

SEQ ID NO: 6451 - protein, 86 aa, Canis lupus familiaris
PSSPTLRTCPTTWPPSRNPSVTPCRKLCHTLAVLTSPIPPYNKVCTSHTPAASQGLHYITVGLLLLLPSLPGNRHRPLPATIHTVT

SEQ ID NO: 6452 - protein, 62 aa, Canis lupus familiaris
PSSPTLRTCPTTWPPSRNPSVTPCRKLSFQNSQIPMSSSRTWIPLTCRAIVTMTSCLSLRTT

SEQ ID NO: 6453 - protein, 32 aa, Canis lupus familiaris
PSSRGPLSNPSPCCQGPSGGRGGPQAGGLHSA

SEQ ID NO: 6454 - protein, 21 aa, Canis lupus familiaris
PSSRMVTCLAMRSACRILTSP

SEQ ID NO: 6455 - protein, 55 aa, Canis lupus familiaris
PSSRPPSSPSPERWARRPRPTPWARAPAVRSWPGSGGSWTRPRGRSGNGRSPGSR

SEQ ID NO: 6456 - protein, 24 aa, Canis lupus familiaris
PSSRPPSSPSPERWARRPRPTPWG

SEQ ID NO: 6457 - protein, 63 aa, Canis lupus familiaris
PSSRRWYLGHRSQPTILLTSAIIRWQGQPRHVIHRKRFNRTLFPSQLYCHGGPHQLTSSIYGC

SEQ ID NO: 6458 - protein, 12 aa, Canis lupus familiaris
PSSSTAGMGNLQ

SEQ ID NO: 6459 - protein, 25 aa, Canis lupus familiaris
PSSTPSSWTSRSSTTKSPSTRTVNC

SEQ ID NO: 6460 - protein, 25 aa, Canis lupus familiaris
PSSTQPRTRDGCLRTRLTSKSLYSK

SEQ ID NO: 6461 - protein, 24 aa, Canis lupus familiaris
PSSTSVLENSPSSHLSTPFSSLLT

SEQ ID NO: 6462 - protein, 14 aa, Canis lupus familiaris
PSSWRVGISRRSYL

SEQ ID NO: 6463 - protein, 30 aa, Canis lupus familiaris
PSSYLRAVPATPSFHPTAALPPTLTFWRQR

SEQ ID NO: 6464 - skipped

SEQ ID NO: 6465 - protein, 28 aa, Canis lupus familiaris
PSTAGPGALARPARLIWPDAIKSELGPA

SEQ ID NO: 6466 - protein, 12 aa, Canis lupus familiaris
PSTAPPTPAADH

SEQ ID NO: 6467 - protein, 35 aa, Canis lupus familiaris
PSTCGGSRGPPFVSSSAATPTARSAQSPSGRHTGP

SEQ ID NO: 6468 - protein, 58 aa, Canis lupus familiaris
PSTCRRSLCRPPRSGCPGMNPWSTPRRLLAMSCTSGRLLTPRSWSTRRHSAKAPFSIC

SEQ ID NO: 6469 - protein, 14 aa, Canis lupus familiaris
PSTCTVCCSARRRS

SEQ ID NO: 6470 - protein, 31 aa, Canis lupus familiaris
PSTDCGGGSLGQHRICFGVKNFVRHTCKTTT

SEQ ID NO: 6471 - protein, 17 aa, Canis lupus familiaris
PSTGGQWEGLPQWGQHC

SEQ ID NO: 6472 - protein, 15 aa, Canis lupus familiaris
PSTGISRMWKQPYMP

SEQ ID NO: 6473 - protein, 15 aa, Canis lupus familiaris
PSTGRLTAQRMPLCL

SEQ ID NO: 6474 - protein, 11 aa, Canis lupus familiaris
PSTGTAQHAPE

SEQ ID NO: 6475 - protein, 8 aa, Canis lupus familiaris
PSTLPLPT

SEQ ID NO: 6476 - protein, 10 aa, Canis lupus familiaris
PSTLQPAEQN

SEQ ID NO: 6477 - protein, 17 aa, Canis lupus familiaris
PSTPESRCWRSLTRAWC

SEQ ID NO: 6478 - protein, 61 aa, Canis lupus familiaris
PSTPHMHSYRALAPEDRVGPYVIPHLEAAELARFFYAVSPPFPLQDITRGNPRRTSWIPGC

SEQ ID NO: 6479 - protein, 13 aa, Canis lupus familiaris
PSTPSHGPMTASP

SEQ ID NO: 6480 - protein, 9 aa, Canis lupus familiaris
PSTPSSTTT

SEQ ID NO: 6481 - skipped

SEQ ID NO: 6482 - protein, 12 aa, Canis lupus familiaris
PSTPTCCGTWSG

SEQ ID NO: 6483 - protein, 30 aa, Canis lupus familiaris
PSTPTMALPPWTPTYLWMSLSTPPSCRSRI

SEQ ID NO: 6484 - protein, 71 aa, Canis lupus familiaris
PSTQAAVPAPSGVPSAASQNPGSDKDGIELFPGGHHSVVQRGAATSASRLPEGLRHYSALVPRDSYIEESK

SEQ ID NO: 6485 - protein, 26 aa, Canis lupus familiaris
PSTRMWREPSPCSPSHHSPVTAACSQ

SEQ ID NO: 6486 - protein, 25 aa, Canis lupus familiaris
PSTSGPESLEGMSCAALSGRLPKWT

SEQ ID NO: 6487 - skipped

SEQ ID NO: 6488 - protein, 11 aa, Canis lupus familiaris
PSTSRPRRVAV

SEQ ID NO: 6489 - protein, 11 aa, Canis lupus familiaris
PSTSRRLRTPA

SEQ ID NO: 6490 - protein, 8 aa, Canis lupus familiaris
PSTSSKGT

SEQ ID NO: 6491 - protein, 9 aa, Canis lupus familiaris
PSTSSPRRL

SEQ ID NO: 6492 - protein, 20 aa, Canis lupus familiaris
PSTSTCRQGWCSWRDAVGRP

SEQ ID NO: 6493 - protein, 8 aa, Canis lupus familiaris
PSTTLSSK

SEQ ID NO: 6494 - protein, 50 aa, Canis lupus familiaris
PSTTTTPACSTPASCPAQAWSVPACRPTRPCAPTRASVSTGGTTPTGFAR

SEQ ID NO: 6495 - protein, 29 aa, Canis lupus familiaris
PSTVCGAVPAGHAEDHRPPGPGPGLPRGG

SEQ ID NO: 6496 - protein, 23 aa, Canis lupus familiaris
PSVHFIQKASIRTSCFTAPSTRS

SEQ ID NO: 6497 - protein, 9 aa, Canis lupus familiaris
PSVHSSPGN

SEQ ID NO: 6498 - protein, 24 aa, Canis lupus familiaris
PSVLPCSERPSRWQKVWKQVLSGS

SEQ ID NO: 6499 - skipped

SEQ ID NO: 6500 - protein, 61 aa, Canis lupus familiaris
PSVPTTALMSPSTSGPRPPQGSSWRIWGALTASGADLMCGWNSTHLGMWSSPSMWGTEMRT

SEQ ID NO: 6501 - protein, 10 aa, Canis lupus familiaris
PSVSQLWLLW

SEQ ID NO: 6502 - protein, 32 aa, Canis lupus familiaris
PSVWSGCPFCIDWQMWKMSSIRLNVLTATVRV

SEQ ID NO: 6503 - protein, 29 aa, Canis lupus familiaris
PSWGPGAPGDSSQRPKEHPHACLWRRPKR

SEQ ID NO: 6504-6505 - skipped (2 entries)

SEQ ID NO: 6506 - protein, 61 aa, Canis lupus familiaris
PTAACRGPGSSLARQQHESHGRGGSSRSSSSSRRTSSPHGPDQPLPQPGGGGWQWPQRRDR

SEQ ID NO: 6507 - protein, 31 aa, Canis lupus familiaris
PTAAPPRSEAPRRGHAPSLQRGPAPRTPALD

SEQ ID NO: 6508 - skipped

SEQ ID NO: 6509 - protein, 24 aa, Canis lupus familiaris
PTAERQQRQLSGHAGHGYLGCQHL

SEQ ID NO: 6510 - protein, 39 aa, Canis lupus familiaris
PTAGCVQDVLPSEGQKAVLDFSIELKDRSVGPDHLFSIQ

SEQ ID NO: 6511 - skipped

SEQ ID NO: 6512 - protein, 14 aa, Canis lupus familiaris
PTAHTEDTRVIPGA

SEQ ID NO: 6513 - protein, 51 aa, Canis lupus familiaris
PTAILTGLLTGVPWISPRVLKMTPFWIPTISHIIHYMLILDPDSILFLRSS

SEQ ID NO: 6514 - skipped

SEQ ID NO: 6515 - protein, 22 aa, Canis lupus familiaris
PTALRSSWQRRKPERSRGCMGC

SEQ ID NO: 6516 - skipped

SEQ ID NO: 6517 - protein, 15 aa, Canis lupus familiaris
PTAPGASAGQWRNSP

SEQ ID NO: 6518 - protein, 19 aa, Canis lupus familiaris
PTAPRALGTRSLARPLPAY

SEQ ID NO: 6519 - protein, 53 aa, Canis lupus familiaris
PTARCTAPGYGFPRSHQLILENTYAEWRTRQAPRRPPSSSLSSTAPTRALATP

SEQ ID NO: 6520 - protein, 12 aa, Canis lupus familiaris
PTASWRPRPGRC

SEQ ID NO: 6521 - protein, 27 aa, Canis lupus familiaris
PTATPCGPAAACAGPSCTGQRGPAHLV

SEQ ID NO: 6522 - protein, 24 aa, Canis lupus familiaris
PTATRARHLHSLYPPEASTMPWAL

SEQ ID NO: 6523 - protein, 21 aa, Canis lupus familiaris
PTATSQRRAPRGTWRGARAGL

SEQ ID NO: 6524 - protein, 38 aa, Canis lupus familiaris
PTATSQRRAPRGTWRGARGEAAPHHPHAVRGAAAQHGV

SEQ ID NO: 6525 - protein, 20 aa, Canis lupus familiaris
PTATSQRRAPRGTWRGARGL

SEQ ID NO: 6526 - protein, 8 aa, Canis lupus familiaris
PTATTACV

SEQ ID NO: 6527 - protein, 39 aa, Canis lupus familiaris
PTAVCGQPAAAWAGGAHRCPCHQGQPAPGAGPGPAAGGA

SEQ ID NO: 6528 - protein, 23 aa, Canis lupus familiaris
PTAWYSPRQLASSRCWALCCCRA

SEQ ID NO: 6529 - skipped

SEQ ID NO: 6530 - protein, 51 aa, Canis lupus familiaris
PTCRPCRATVPRETTSQAMGCLSMHLSVEHPMEIRCPVVRIQAFQSIRMSH

SEQ ID NO: 6531 - protein, 36 aa, Canis lupus familiaris
PTCYCRGTQTAPRPLDQQCLSDPLSEPTAEPYQNFI

SEQ ID NO: 6532 - protein, 18 aa, Canis lupus familiaris
PTDHRETPTSALLPGPQV

SEQ ID NO: 6533 - skipped

SEQ ID NO: 6534 - protein, 10 aa, Canis lupus familiaris
PTENMKQVSK

SEQ ID NO: 6535 - protein, 12 aa, Canis lupus familiaris
PTFATSPSAVAA

SEQ ID NO: 6536-6537 - skipped (2 entries)

SEQ ID NO: 6538 - protein, 24 aa, Canis lupus familiaris
PTGGTGLSCLLSSQATVQDSSKDL

SEQ ID NO: 6539 - protein, 35 aa, Canis lupus familiaris
PTGLPLPSHQLFHGVPWFAPSSSPRILRACQQSPD

SEQ ID NO: 6540 - protein, 24 aa, Canis lupus familiaris
PTGLWFCQSPAPPWGGSQRQGVAC

SEQ ID NO: 6541 - protein, 38 aa, Canis lupus familiaris
PTGPCCPPDGLPSSRRHSPTAPARLSPSPPAAPAQQWQ

SEQ ID NO: 6542 - protein, 27 aa, Canis lupus familiaris
PTGPGLPVRCPHCSCNPLCSVIFCQMI

SEQ ID NO: 6543 - protein, 30 aa, Canis lupus familiaris
PTGPPLSLGPTRPLLHTASPPSLGLGLHPG

SEQ ID NO: 6544 - protein, 9 aa, Canis lupus familiaris
PTGPPSTFS

SEQ ID NO: 6545 - protein, 59 aa, Canis lupus familiaris
PTGSASRLWTPVGVDPAAATTGALLLPGLRPELFPRVPPTLQNGMVRPSAVTVGRQSWL

SEQ ID NO: 6546 - protein, 11 aa, Canis lupus familiaris
PTGWPAANELL

SEQ ID NO: 6547 - protein, 99 aa, Canis lupus familiaris
PTHPLPQCPLHQPPSPLLPFLPPLLAIPLLPPPTTPTSHPHPHACPPPTQCPLTLLQAWACHRPATPLRLSPLEDSHPCPHPSPHPVCLQLGGWGGQPG

SEQ ID NO: 6548 - protein, 10 aa, Canis lupus familiaris
PTHRGAEYQP

SEQ ID NO: 6549 - skipped

SEQ ID NO: 6550 - protein, 38 aa, Canis lupus familiaris
PTIPRGVGGEPVPWNHLSGFSPKNHRDPPDQPTPFPPS

SEQ ID NO: 6551 - protein, 10 aa, Canis lupus familiaris
PTKPQPGPQS

SEQ ID NO: 6552 - protein, 44 aa, Canis lupus familiaris
PTKTSRLPHWSCTAACLPSPWACSSPRQPSGACPWPSSTPDCHP

SEQ ID NO: 6553 - protein, 12 aa, Canis lupus familiaris
PTKYQSHYCCLL

SEQ ID NO: 6554 - protein, 32 aa, Canis lupus familiaris
PTLDWSPGASWNPAYLLLCHSACRVPLMSPAA

SEQ ID NO: 6555-6556 - skipped (2 entries)

SEQ ID NO: 6557 - protein, 8 aa, Canis lupus familiaris
PTLHLILK

SEQ ID NO: 6558 - skipped

SEQ ID NO: 6559 - protein, 17 aa, Canis lupus familiaris
PTLPGSPCGRGRKADRC

SEQ ID NO: 6560 - protein, 29 aa, Canis lupus familiaris
PTLTVATSNADQSNPKELQWAHRHRCPRG

SEQ ID NO: 6561 - protein, 93 aa, Canis lupus familiaris
PTLWGWWNLERVPLPPLRRMPLALQESPGWTVRQRVTTMMPSSPSCLLRSSCPCHPGNAGPSLSVPCQRNETPLQRRMDAAPTSGRRTISGGP

SEQ ID NO: 6562 - protein, 67 aa, Canis lupus familiaris
PTLWRLPTRPGDIPPAFPAVPLPGRRRSAGGVPAAAGALPPVAATRHPHEGADRGDAGAGAAAGHPA

SEQ ID NO: 6563 - protein, 27 aa, Canis lupus familiaris
PTMLQPSSTLCSSPTGLWAASTGRVRR

SEQ ID NO: 6564 - skipped

SEQ ID NO: 6565 - protein, 23 aa, Canis lupus familiaris
PTNHRSELGAGHCYRQQQCLPVL

SEQ ID NO: 6566 - protein, 12 aa, Canis lupus familiaris
PTPAATRTGRWS

SEQ ID NO: 6567 - protein, 8 aa, Canis lupus familiaris
PTPAGEKD

SEQ ID NO: 6568 - protein, 24 aa, Canis lupus familiaris
PTPALRGLLKTGTLRRSCQERNCP

SEQ ID NO: 6569 - protein, 8 aa, Canis lupus familiaris
PTPARAAW

SEQ ID NO: 6570 - skipped

SEQ ID NO: 6571 - protein, 25 aa, Canis lupus familiaris
PTPCHSPQHRGHCQPWRVWAAQAGS

SEQ ID NO: 6572 - protein, 51 aa, Canis lupus familiaris
PTPCTPLPSPTPQCSHPSDSIPTVHPSPSPSRPTSQQGATPLPTSSQAFCL

SEQ ID NO: 6573 - protein, 72 aa, Canis lupus familiaris
PTPCYPPDCGSGHTVVCGLHSGWGVPSFGGPSPPGVSRREAALHSPVQKGLPLGHGKCQSKPRRRGYPAAMV

SEQ ID NO: 6574 - protein, 14 aa, Canis lupus familiaris
PTPFLKNRLQILWL

SEQ ID NO: 6575 - protein, 97 aa, Canis lupus familiaris
PTPFVLPVCPPQGARRVHRHSPRACGHFDSNTGGAREPGPAGHGAPGETTVPPHPLSATMELGWWGPGLVLPGRVGPHSCIRGGTSRAARRIGAGPG

SEQ ID NO: 6576 - protein, 17 aa, Canis lupus familiaris
PTPFWPAPPAHPPLSAG

SEQ ID NO: 6577 - skipped

SEQ ID NO: 6578 - protein, 44 aa, Canis lupus familiaris
PTPGPQGGPESAGLWCGSGKTEPQIPAQRTPGCAADTLSRRPTL

SEQ ID NO: 6579 - protein, 85 aa, Canis lupus familiaris
PTPGRLLRALCRPGLLLPAHGRGTLVPAVPHLQRALLQRAELGQPDYGGEAGFLQGPPLPGPTPREWPEIPQSPQQLCFQEAVCV

SEQ ID NO: 6580 - protein, 51 aa, Canis lupus familiaris
PTPGRYGRALASPVETRCLLWLALEPPWLRGQGRGEGRAPSQAGNEWGRRC

SEQ ID NO: 6581 - protein, 85 aa, Canis lupus familiaris
PTPHHGPHQLRTGQPMAESPRPSLWTPARPRTPHPPRMPAGRWGAGVSAPPPAAWVLSGGPSAAAPAAKRTVPPPAAPSLPAAAT

SEQ ID NO: 6582 - protein, 21 aa, Canis lupus familiaris
PTPHHRWLHQRSTQRLQRPRL

SEQ ID NO: 6583 - protein, 49 aa, Canis lupus familiaris
PTPHICAHGPLPSAQWALHPTKGPAQPSQGGGQTGGHDSIAGFPGRGTR

SEQ ID NO: 6584 - protein, 40 aa, Canis lupus familiaris
PTPHICAHGPLPSAQWALHPTKGPAQPSQGGGQTGGHDST

SEQ ID NO: 6585 - protein, 38 aa, Canis lupus familiaris
PTPLGPPGGPTAARPWRPPRAPRWRLSCRGPWLTPSSS

SEQ ID NO: 6586 - protein, 38 aa, Canis lupus familiaris
PTPLPGRHAPGGRLPALGVLAAVPGQRRPAGQEQGAQR

SEQ ID NO: 6587 - protein, 62 aa, Canis lupus familiaris
PTPMPWSSPITNLTTTPGADGCEPGGRPFRLLPTSPSACPPAPGCLSPPDSDDRRSSTPPTP

SEQ ID NO: 6588 - protein, 28 aa, Canis lupus familiaris
PTPPHCSRRVLSFCLSNSSRGVSSRRMR

SEQ ID NO: 6589 - protein, 45 aa, Canis lupus familiaris
PTPPLWPRRRSTGQPLRRTAGLPAKRPPPPLTTAAAALRLLGGKS

SEQ ID NO: 6590 - protein, 64 aa, Canis lupus familiaris
PTPPQGAHLSPNALLLPLPRRERPRPPAGLARTAVKIALPARARQLAGPAGGDAADPSSPPVGL

SEQ ID NO: 6591 - protein, 56 aa, Canis lupus familiaris
PTPPRKGHGPPTGPLDVSAGGWDSRCERWGHAAGQWGHRQRGPRGDLLQWPVGDRV

SEQ ID NO: 6592 - protein, 46 aa, Canis lupus familiaris
PTPPRSLATNSTGGRWGPRRRLVVRVPQGATETRPGMWGLSGSRRK

SEQ ID NO: 6593 - protein, 20 aa, Canis lupus familiaris
PTPPVLRPGPDLFGRGLDQP

SEQ ID NO: 6594-6595 - skipped (2 entries)

SEQ ID NO: 6596 - protein, 53 aa, Canis lupus familiaris
PTPRGGEGSAAPCPPCVPWACTLGPPHTRRGDCVPTRGLFRVSQQAARLLGSV

SEQ ID NO: 6597 - protein, 13 aa, Canis lupus familiaris
PTPRPLHSCHRQV

SEQ ID NO: 6598 - skipped

SEQ ID NO: 6599 - protein, 67 aa, Canis lupus familiaris
PTPRSAWAQRLQAQQTPQTGPHQQPPRCSRPGRGSSRLLELPPALAQLAGPRLLQMCLLGLTAGSRR

SEQ ID NO: 6600 - protein, 18 aa, Canis lupus familiaris
PTPSSDPASPATHARSTP

SEQ ID NO: 6601 - protein, 35 aa, Canis lupus familiaris
PTPSWEPWNQGRVLHLSSWTLRRRAWRPRSAAWQS

SEQ ID NO: 6602 - skipped

SEQ ID NO: 6603 - protein, 16 aa, Canis lupus familiaris
PTPTPTASRRSTGCQP

SEQ ID NO: 6604 - protein, 22 aa, Canis lupus familiaris
PTPTPWTMQISILSSLRPVAPF

SEQ ID NO: 6605 - skipped

SEQ ID NO: 6606 - protein, 71 aa, Canis lupus familiaris
PTPVSNRKAYSGQPTASEDFGPKPPESGEPVAHDAVAGRAQPQCWPLPCPPPGQEFHAPRRAASGTVERPV

SEQ ID NO: 6607 - protein, 86 aa, Canis lupus familiaris
PTPWSSSSQSQSHCRGAPSPPPRPASWECRGPLSQDGSPVGRPSSPTLILSQGCCPHTQRKPRAPLSRCRANGRGASPCPAPSPGR

SEQ ID NO: 6608 - protein, 13 aa, Canis lupus familiaris
PTQAHLPKCPRPL

SEQ ID NO: 6609 - protein, 9 aa, Canis lupus familiaris
PTQAPATRY

SEQ ID NO: 6610 - protein, 24 aa, Canis lupus familiaris
PTQEPVPPSLERTRGALLRPRSPH

SEQ ID NO: 6611 - protein, 52 aa, Canis lupus familiaris
PTQEVAKIQLQFLWTFPKMLFLFFLLIFFLFFLIFVIQFSKPVPLPIPPTEK

SEQ ID NO: 6612 - skipped

SEQ ID NO: 6613 - protein, 22 aa, Canis lupus familiaris
PTQQCLRPAGPVAAALAAPTAS

SEQ ID NO: 6614 - protein, 41 aa, Canis lupus familiaris
PTQQGPPHGPAGPPQLHCPAGPPPPPPAGTQRLRRGRAVWA

SEQ ID NO: 6615 - protein, 35 aa, Canis lupus familiaris
PTQRAWSWIRRVPSTTGYKDGKRQAGARAPRDLRS

SEQ ID NO: 6616 - protein, 30 aa, Canis lupus familiaris
PTRAAVICWSLWMTQPPQPPSLGPPTLLLP

SEQ ID NO: 6617 - protein, 22 aa, Canis lupus familiaris
PTRASTGSWASRTRTTRALART

SEQ ID NO: 6618 - protein, 32 aa, Canis lupus familiaris
PTRHLPGTTPSSSGVPMCLPSQAPPAGSGGKR

SEQ ID NO: 6619 - protein, 15 aa, Canis lupus familiaris
PTRPCCWSPSSWQPG

SEQ ID NO: 6620 - protein, 17 aa, Canis lupus familiaris
PTRPTSAAPLPYATCCL

SEQ ID NO: 6621 - protein, 23 aa, Canis lupus familiaris
PTRSPTTRIWWARPPPVSLVLLP

SEQ ID NO: 6622 - protein, 54 aa, Canis lupus familiaris
PTSCTPAAPRWHRRPGCWTPTCTSATPWPPVPPPRCPPALWPRGSRRGTVRWRT

SEQ ID NO: 6623 - protein, 10 aa, Canis lupus familiaris
PTSFAWCIRR

SEQ ID NO: 6624 - protein, 37 aa, Canis lupus familiaris
PTSGPCSPAPAGFCGSPTVRFWGPASAELLRPATGEP

SEQ ID NO: 6625 - protein, 21 aa, Canis lupus familiaris
PTSHQRLRPGHHPHLGPAPLG

SEQ ID NO: 6626 - protein, 13 aa, Canis lupus familiaris
PTSLPLPIIAIST

SEQ ID NO: 6627 - protein, 13 aa, Canis lupus familiaris
PTSMPSQTPPTGV

SEQ ID NO: 6628 - skipped

SEQ ID NO: 6629 - protein, 61 aa, Canis lupus familiaris
PTSPSASRSPPPCIWIFCGIRVRRQSPFDWTCGCHRRSETEESVPDGGCLFPRRRCEPSLI

SEQ ID NO: 6630 - protein, 14 aa, Canis lupus familiaris
PTSPTPSEPASCTA

SEQ ID NO: 6631 - protein, 17 aa, Canis lupus familiaris
PTSQGPTSTKEPGGPRS

SEQ ID NO: 6632 - protein, 10 aa, Canis lupus familiaris
PTSQRNRPQQ

SEQ ID NO: 6633 - protein, 22 aa, Canis lupus familiaris
PTSRPSADSWVTRASQWSWRNC

SEQ ID NO: 6634 - protein, 21 aa, Canis lupus familiaris
PTSSSFLYACWPFTSQSNQIP

SEQ ID NO: 6635 - protein, 72 aa, Canis lupus familiaris
PTSSSWSCSLWRESCTWETSASAKMGITPGWRVWTCWPSPPTCWASTAHGCRRSSPAARWTVAGADAVSPSM

SEQ ID NO: 6636 - skipped

SEQ ID NO: 6637 - protein, 70 aa, Canis lupus familiaris
PTSTRRRLPPPAPTPATVARPSPALPTGCPPLSVSSGTGGHGHPARPSPSAASAGGSRETTCHSARTGER

SEQ ID NO: 6638 - protein, 11 aa, Canis lupus familiaris
PTSWAPTVRRK

SEQ ID NO: 6639 - protein, 48 aa, Canis lupus familiaris
PTTAPALGQPPGLCLPPMREVLPDSGRPLPPPAQPRGGRRAGVPLWQL

SEQ ID NO: 6640 - protein, 42 aa, Canis lupus familiaris
PTTARQCPACHQGDTTKDLQAVGGRLRGQEPDSLRPKGKRYQ

SEQ ID NO: 6641 - protein, 10 aa, Canis lupus familiaris
PTTFILSSKN

SEQ ID NO: 6642 - protein, 23 aa, Canis lupus familiaris
PTTGSRPTAPRFWITMWPERSAT

SEQ ID NO: 6643 - protein, 23 aa, Canis lupus familiaris
PTTPASPRSEVLRRVPYATPALV

SEQ ID NO: 6644 - protein, 11 aa, Canis lupus familiaris
PTTPSAECVRS

SEQ ID NO: 6645 - protein, 23 aa, Canis lupus familiaris
PTTRETEQSFQRQVDGCQGWTAR

SEQ ID NO: 6646 - protein, 43 aa, Canis lupus familiaris
PTTRPPAPRSSCAARRPTTAACPAPACTPTAGPATRRWNSTRT

SEQ ID NO: 6647 - protein, 84 aa, Canis lupus familiaris
PTTSFPLPACASLLCVSCAPDRDGCEERDQDKHEEHGKGASVPSVSRDVQAATGAALYSQRVPGLCPGGAGPARLYRPLWGPQL

SEQ ID NO: 6648 - protein, 30 aa, Canis lupus familiaris
PTTVTFPPRWRSRECRQPEKVVTLSRLLRS

SEQ ID NO: 6649 - protein, 54 aa, Canis lupus familiaris
PTVPPTFSTPYPHSFKFCAAGCQPGSPLGDAPPALCPECPPTWTTYLQCHHGNY

SEQ ID NO: 6650 - skipped

SEQ ID NO: 6651 - protein, 25 aa, Canis lupus familiaris
PTWEATWTTRTFATSSRMATPRTRS

SEQ ID NO: 6652 - skipped

SEQ ID NO: 6653 - protein, 51 aa, Canis lupus familiaris
PTWRPGRHGPGSPQLGGQLRGAASRRSWGPWPERPGPRVPSSFWSWRYLSG

SEQ ID NO: 6654 - protein, 26 aa, Canis lupus familiaris
PTWSAGSRPRSRSASTTTWAPVPRCT

SEQ ID NO: 6655 - protein, 21 aa, Canis lupus familiaris
PTWVGSGGSSLARTGKSGLPL

SEQ ID NO: 6656 - protein, 38 aa, Canis lupus familiaris
PTYLHQQMLLTNVWLLSAKTSALSSVEKVALGRQRVPT

SEQ ID NO: 6657 - protein, 51 aa, Canis lupus familiaris
PTYWSTGLCRLPVGCITCTVRPWCLSSTETSSPTTFCCCSPLKVMTWTTRP

SEQ ID NO: 6658 - protein, 17 aa, Canis lupus familiaris
PVAAHLLPGAGHHPALL

SEQ ID NO: 6659 - protein, 26 aa, Canis lupus familiaris
PVAGPCHCTPGTPGRIWLAVTSCWIS

SEQ ID NO: 6660 - protein, 55 aa, Canis lupus familiaris
PVARPVPGLGLVFHRQHPHTLPRQCQHHTPAASHLCGTHRHFWSQPANQSGPTPG

SEQ ID NO: 6661 - protein, 31 aa, Canis lupus familiaris
PVATRSLPCPGRRTVQDSERRREGSRFVEGS

SEQ ID NO: 6662 - protein, 8 aa, Canis lupus familiaris
PVEGVPYL

SEQ ID NO: 6663 - protein, 29 aa, Canis lupus familiaris
PVFPYLPVSICDGGHGYQQHQYAYQHVFQ

SEQ ID NO: 6664 - protein, 16 aa, Canis lupus familiaris
PVFSTSGSYWQTCRCL

SEQ ID NO: 6665 - protein, 31 aa, Canis lupus familiaris
PVGMTGPQEAETRGRGAPLAGRREPARLLRS

SEQ ID NO: 6666 - protein, 49 aa, Canis lupus familiaris
PVGMTGPQEAETRGRGAPLAGRREPARLLRSPRLGGSLVTRGSGLMRAP

SEQ ID NO: 6667 - skipped

SEQ ID NO: 6668 - protein, 17 aa, Canis lupus familiaris
PVGPARNLGAALGWPSQ

SEQ ID NO: 6669 - protein, 19 aa, Canis lupus familiaris
PVGWGFSWTMNQETSPSTI

SEQ ID NO: 6670 - skipped

SEQ ID NO: 6671 - protein, 53 aa, Canis lupus familiaris
PVHPGVRGGGPPRLSLGAGRQSRGGGRVGPPGDEQRPTSGSPLPAGGGRGRLA

SEQ ID NO: 6672 - protein, 36 aa, Canis lupus familiaris
PVHRGQGGWQCDHDLHSFWEPQAHCHLAQGGDTPRC

SEQ ID NO: 6673 - protein, 39 aa, Canis lupus familiaris
PVHRGSGPVPGIPGPAPCALSPHPGNCLPGPLGGFRSHL

SEQ ID NO: 6674 - protein, 23 aa, Canis lupus familiaris
PVHWHEETADTRAWGQPAVLLPT

SEQ ID NO: 6675 - protein, 40 aa, Canis lupus familiaris
PVHWHEETGLDKEGVPTELRRQRHVLFLPEAGLRDGKAEC

SEQ ID NO: 6676 - protein, 23 aa, Canis lupus familiaris
PVICTFQPASSSPDTRKQQDSQQ

SEQ ID NO: 6677 - protein, 15 aa, Canis lupus familiaris
PVIPPPASATVLGGP

SEQ ID NO: 6678 - protein, 21 aa, Canis lupus familiaris
PVLALSWCIAVLVLDGLAVTS

SEQ ID NO: 6679 - skipped

SEQ ID NO: 6680 - protein, 34 aa, Canis lupus familiaris
PVLRGVPRRGALGVVLGPRLPVRRLLSQRPDWWR

SEQ ID NO: 6681 - protein, 14 aa, Canis lupus familiaris
PVLRSTSPSSGALS

SEQ ID NO: 6682 - protein, 22 aa, Canis lupus familiaris
PVLSGIYRTWLVFIFDVHLEIS

SEQ ID NO: 6683 - protein, 18 aa, Canis lupus familiaris
PVLVPISCSVASASWPLA

SEQ ID NO: 6684 - protein, 66 aa, Canis lupus familiaris
PVLVVALVMPVLLVPLALLDPLVPPVLPAAVSTSASCPSHLRRRLTMAAATTGPMMPTWSVTVTSR

SEQ ID NO: 6685 - protein, 11 aa, Canis lupus familiaris
PVMERRIAACR

SEQ ID NO: 6686 - skipped

SEQ ID NO: 6687 - protein, 94 aa, Canis lupus familiaris
PVPAAAPARARRSAAARGPRGQRRPPGPQQNHCDNRQGCQQRTGGKAKQVTAAEKGLPRVRRRCCVAAHWNLVSLLGHLLHGGFKWCGHVCSPA

SEQ ID NO: 6688 - protein, 41 aa, Canis lupus familiaris
PVPDRSVGLPVADFQNHAWSRPDQDPGRPVLAGPHLHGLPL

SEQ ID NO: 6689 - protein, 42 aa, Canis lupus familiaris
PVPGPGSPGHAAAAETQPCTMLCSLVTCNRSKPCSKMKMLPT

SEQ ID NO: 6690 - protein, 55 aa, Canis lupus familiaris
PVPGRATGTERPEQLAWWRGWPGGWRAAGEAAGGGPEPRRCWPGRQGGGPPRLGG

SEQ ID NO: 6691 - protein, 34 aa, Canis lupus familiaris
PVPGWHSSATGASHSPSPGPASPAGAASAVKSTS

SEQ ID NO: 6692 - skipped

SEQ ID NO: 6693 - protein, 77 aa, Canis lupus familiaris
PVPPLFLPLLSAVPCWATLRNHCCEDALHHLATLRASQQRLELVDPTAPSMSRCLSLSPSLMFLSKMPRPPSWVSWT

SEQ ID NO: 6694 - protein, 17 aa, Canis lupus familiaris
PVPVHRPCLRVVASPSQ

SEQ ID NO: 6695 - protein, 20 aa, Canis lupus familiaris
PVQAAQTPRPATGKSTSSSC

SEQ ID NO: 6696 - protein, 68 aa, Canis lupus familiaris
PVQFSRKGLRLPEQPAVPCPPGAPRGRRQREGRGEGLPPRGRAGHLSRRRGPRLWLWRPTVRHGQNLL

SEQ ID NO: 6697 - protein, 68 aa, Canis lupus familiaris
PVQFSRKGLRLPEQPAVPRPPGAPRGRRQREGRGERLPPRGRAGHLSRRRGPRLWLWRPTVRHGQNLL

SEQ ID NO: 6698 - protein, 70 aa, Canis lupus familiaris
PVQPVPPHPGWLSQAAGTGRGAAPGGAEAGAAVAGSERGAQLGQRLVALGLQGHRGGRAGGGWGAVPDPP

SEQ ID NO: 6699 - protein, 9 aa, Canis lupus familiaris
PVRCVPDAP

SEQ ID NO: 6700 - skipped

SEQ ID NO: 6701 - protein, 10 aa, Canis lupus familiaris
PVSGLAAPSA

SEQ ID NO: 6702 - skipped

SEQ ID NO: 6703 - protein, 19 aa, Canis lupus familiaris
PVSNLPAFPQWKPPDQTVP

SEQ ID NO: 6704 - protein, 40 aa, Canis lupus familiaris
PVSRPLSILHHQGHLDPTTARPGFTCTVVNTGLRMSKPWK

SEQ ID NO: 6705 - skipped

SEQ ID NO: 6706 - protein, 51 aa, Canis lupus familiaris
PVSRPLSILHHQGHLDPTTARPGFTCTVVNTVLTLRCTPSTAAHHRHCRLD

SEQ ID NO: 6707 - protein, 30 aa, Canis lupus familiaris
PVSRTQTVTARNWTTPTVAKPCSLRPPSLH

SEQ ID NO: 6708 - protein, 31 aa, Canis lupus familiaris
PVSYPLKGCSAHPRRTVASASPGSRWNILKN

SEQ ID NO: 6709 - protein, 13 aa, Canis lupus familiaris
PVTAGDHPSTGAR

SEQ ID NO: 6710 - protein, 32 aa, Canis lupus familiaris
PVTGRPGAGTPRVVSGVSAQTLRCSGRTERRV

SEQ ID NO: 6711 - protein, 18 aa, Canis lupus familiaris
PVTTLGPLLRMGSTVASP

SEQ ID NO: 6712 - protein, 21 aa, Canis lupus familiaris
PVVAQRLWLTEVQHVQCPQQW

SEQ ID NO: 6713 - skipped

SEQ ID NO: 6714 - protein, 81 aa, Canis lupus familiaris
PVWERGAHQMRSLGAHCPLQTFHPHPCQTRPSSCPPAWILCQGRWSGAAVGVRPVAHHLTRPIQDLHCPQAPHLPALSWGR

SEQ ID NO: 6715 - protein, 56 aa, Canis lupus familiaris
PVWRRFQDRNARGRVPPSCRTFTSGTWLPTLTMPTAGGPGGRARLLQTWRSCTGSM

SEQ ID NO: 6716 - protein, 52 aa, Canis lupus familiaris
PWAARSWCGSRAAAVAPLAPWARGCPAGCIPLAAARACAATRPGGWRSPCTR

SEQ ID NO: 6717 - protein, 13 aa, Canis lupus familiaris
PWAFPSQRRGRSP

SEQ ID NO: 6718 - protein, 48 aa, Canis lupus familiaris
PWAFRAWSCRLPRWARFPCSTLPPCPGRSPLPPARSQTRSSSVHARSA

SEQ ID NO: 6719 - protein, 84 aa, Canis lupus familiaris
PWAFRAWSCRLPRWARFPCSTLPPCPGRSPLPPARSQVRGLCISGCPAWDPRLTSSSAPQTWLTPSRPRSPPQTRSSSVHARSA

SEQ ID NO: 6720 - protein, 19 aa, Canis lupus familiaris
PWALASSAHTGWPASGWWA

SEQ ID NO: 6721 - protein, 20 aa, Canis lupus familiaris
PWALGPLLASSWVPYWAWPS

SEQ ID NO: 6722 - protein, 80 aa, Canis lupus familiaris
PWARGPRACQRLVGEGGRPLPGNAPVAGPQNLTWPAASPPSAWKSASNMILRTSRRQAAGASASPAPATSEMGRPGAQPP

SEQ ID NO: 6723 - protein, 55 aa, Canis lupus familiaris
PWASTRPPPCPRGPQSRLGSSSPGPCSLWPPLSSRRPRPGRPPGDQGGSRRTWWR

SEQ ID NO: 6724 - skipped

SEQ ID NO: 6725 - protein, 25 aa, Canis lupus familiaris
PWCWWAPRGGFASQMGRGVAPSPAA

SEQ ID NO: 6726 - protein, 55 aa, Canis lupus familiaris
PWETRSTWQPSGPWSCPSRTSLPQTWCSCHQALTLWRATPRPSAATTSPPNVSGT

SEQ ID NO: 6727 - protein, 13 aa, Canis lupus familiaris
PWGFTASMPTMIR

SEQ ID NO: 6728 - protein, 27 aa, Canis lupus familiaris
PWGRRMRTWPESGNGWCTGPPRRTCWC

SEQ ID NO: 6729 - protein, 41 aa, Canis lupus familiaris
PWHCTRIRKDRARSQAPRRKKPKPVTRTQKTIKIKMPNLSL

SEQ ID NO: 6730 - protein, 75 aa, Canis lupus familiaris
PWHPILYPKRMSSGRPPSSRLWCWALLHQTPACWAPPLATLLALGSFSLKSCRACSLGPWLPACPPQANNSCPTC

SEQ ID NO: 6731 - protein, 28 aa, Canis lupus familiaris
PWHTGIHYVTARFHPICGIKEKRVPLSC

SEQ ID NO: 6732 - protein, 82 aa, Canis lupus familiaris
PWIPRRSPSSSSSWRSIIMWAQHSPCPEHPRHPATPCLSCEPLESQMRACPSAATSMALHPTSIPRRPLVLGPSTWVTCSGS

SEQ ID NO: 6733 - protein, 31 aa, Canis lupus familiaris
PWKVDPARAVHPPPPRPAGDPGTRAWPRCCR

SEQ ID NO: 6734 - protein, 21 aa, Canis lupus familiaris
PWLADLCPLQRWQLPTASTSP

SEQ ID NO: 6735 - skipped

SEQ ID NO: 6736 - protein, 20 aa, Canis lupus familiaris
PWLPPPPTPGRPARPGTSGT

SEQ ID NO: 6737 - protein, 19 aa, Canis lupus familiaris
PWLVRVTALRGLLAGFGWL

SEQ ID NO: 6738 - protein, 11 aa, Canis lupus familiaris
PWMTATSTLAP

SEQ ID NO: 6739 - skipped

SEQ ID NO: 6740 - protein, 28 aa, Canis lupus familiaris
PWNPVPDRHRPPTLRLLHGGQLRCRHGG

SEQ ID NO: 6741 - protein, 37 aa, Canis lupus familiaris
PWNSQIVLIFPTTALLLSPLSRTWSSRRNTTPPSPPR

SEQ ID NO: 6742-6745 - skipped (4 entries)

SEQ ID NO: 6746 - protein, 17 aa, Canis lupus familiaris
PWQDGRGVARWAALQRP

SEQ ID NO: 6747 - protein, 12 aa, Canis lupus familiaris
PWQVPVPKEGSQ

SEQ ID NO: 6748 - protein, 11 aa, Canis lupus familiaris
PWRGEASLPGL

SEQ ID NO: 6749 - protein, 26 aa, Canis lupus familiaris
PWRGPVRDGLCAQRRKPDPPGHGLLH

SEQ ID NO: 6750 - protein, 76 aa, Canis lupus familiaris
PWRPSTGSCARQLAKSPAHPQRTVAFLPPSVSPPASRNCMSTLERRSGCCRWCVEGPRLTMGAADPRQKRNRSSAA

SEQ ID NO: 6751 - protein, 20 aa, Canis lupus familiaris
PWRQPLCSGWPQLFIFTPSW

SEQ ID NO: 6752 - protein, 36 aa, Canis lupus familiaris
PWRRSPPSPLSSLSAILLAPCRSWWCRRAGGCLSTR

SEQ ID NO: 6753 - protein, 29 aa, Canis lupus familiaris
PWRSPGSLLPTQGPARGPGPGTRMSPPCP

SEQ ID NO: 6754 - protein, 14 aa, Canis lupus familiaris
PWRTPQQWDPTLLQ

SEQ ID NO: 6755 - protein, 55 aa, Canis lupus familiaris
PWSHPETGSAVHGAHPKREAASDRHRGCLLPPTPAHAPAPHLRPGPFSLPWTSGE

SEQ ID NO: 6756 - protein, 28 aa, Canis lupus familiaris
PWSPGVGAPPRLPAWSPHPRRRTRRAVT

SEQ ID NO: 6757 - protein, 28 aa, Canis lupus familiaris
PWSPLLGSERCPWPAQVPGLLRPSRGWP

SEQ ID NO: 6758 - protein, 13 aa, Canis lupus familiaris
PWSSEMHPLHQHC

SEQ ID NO: 6759 - protein, 29 aa, Canis lupus familiaris
PWTPVWGWGISEARGAPPTSHRPWKSQCL

SEQ ID NO: 6760 - protein, 15 aa, Canis lupus familiaris
PWTQLFTKAWRQILC

SEQ ID NO: 6761 - skipped

SEQ ID NO: 6762 - protein, 60 aa, Canis lupus familiaris
PWTSCVPSAKPWRRGSVLTHSTWSYCTARGARASSASSSPPTCTTARSLQGQTRRWPRLP

SEQ ID NO: 6763 - protein, 9 aa, Canis lupus familiaris
PWTTSPKTP

SEQ ID NO: 6764 - protein, 68 aa, Canis lupus familiaris
PWVAEEPVVILQGTSWFWQHTTYGQHCLGPRLYHFTSKASQHTDPVSKRSNAGIASQPTLEVTVGNSL

SEQ ID NO: 6765 - protein, 49 aa, Canis lupus familiaris
PWVLWPPEWTKHALAVVHPSWVWTKRTPRQEPAGRSHGLLKITRRLALT

SEQ ID NO: 6766 - protein, 23 aa, Canis lupus familiaris
PWVPEEPLATLQGASCFWQHTTQ

SEQ ID NO: 6767 - protein, 68 aa, Canis lupus familiaris
PWVPEEPLVILQGTSRFWQHTTYQQHCLGPRLYQFPSKVGQHTDPCSDASQPRNRLSAHNWRSQWATA

SEQ ID NO: 6768 - protein, 68 aa, Canis lupus familiaris
PWVPEEPLVILQGTSRFWQHTTYQQHCLGPRLYQFPSKVGQHTDPRSDASQPRNRLSAHNWRSQWATA

SEQ ID NO: 6769 - protein, 38 aa, Canis lupus familiaris
PWVWGRSVRPEWLTRGSFAWICLWPTTTPSTSILPSWL

SEQ ID NO: 6770 - protein, 79 aa, Canis lupus familiaris
PWWRTVWQWGTPRWWLWRGSCPRRALWTTSWWGTLWGAPLWNSRRTIWWCGPGGPLWSATSKFLRCPASWALWTGTSSR

SEQ ID NO: 6771 - protein, 12 aa, Canis lupus familiaris
PWWWKCMTGTAN

SEQ ID NO: 6772 - protein, 26 aa, Canis lupus familiaris
PWYSPHLCPHSGARALSCFSGATLGT

SEQ ID NO: 6773 - protein, 35 aa, Canis lupus familiaris
PYADPHEQSANGHLGRHFHRTHFPWCVSSSSSSWK

SEQ ID NO: 6774 - protein, 13 aa, Canis lupus familiaris
PYCSPHFQHPLPS

SEQ ID NO: 6775 - protein, 65 aa, Canis lupus familiaris
PYEPLWPTASTTAAPGPLAAQCHCLGGTGREGGAPCSGTRRCQCGCPRCSPGPKCSEPGKGGQSR

SEQ ID NO: 6776 - protein, 43 aa, Canis lupus familiaris
PYLLFAQSSPAFSRTSPWRSPKNFRRLYLPCTTSGCAARWPFS

SEQ ID NO: 6777 - protein, 14 aa, Canis lupus familiaris
PYMSNSPFLRSMRC

SEQ ID NO: 6778 - protein, 16 aa, Canis lupus familiaris
PYPHPHHFTHSLREQG

SEQ ID NO: 6779 - protein, 26 aa, Canis lupus familiaris
PYPPQERPWPSHWSSGCVCWWLGLKV

SEQ ID NO: 6780 - skipped

SEQ ID NO: 6781 - protein, 21 aa, Canis lupus familiaris
PYRRRRPRAPKVRLWTRIPGC

SEQ ID NO: 6782 - protein, 22 aa, Canis lupus familiaris
PYSGLLLRASQTQETPHGPGDR

SEQ ID NO: 6783 - protein, 9 aa, Canis lupus familiaris
QAAAASRLP

SEQ ID NO: 6784 - protein, 36 aa, Canis lupus familiaris
QAALQRGRQVDGSRRGLPLPAGPPAGPRRQGLPSLP

SEQ ID NO: 6785 - protein, 33 aa, Canis lupus familiaris
QADRVHLRSDRPGRQRLPTSSRPGGSPEAPRLH

SEQ ID NO: 6786 - protein, 17 aa, Canis lupus familiaris
QAGLGDCLFERLTLKHD

SEQ ID NO: 6787 - protein, 18 aa, Canis lupus familiaris
QAGSRSALGRWNPNRGQS

SEQ ID NO: 6788 - protein, 9 aa, Canis lupus familiaris
QAGTAGPRA

SEQ ID NO: 6789 - protein, 9 aa, Canis lupus familiaris
QALCQALSS

SEQ ID NO: 6790 - protein, 29 aa, Canis lupus familiaris
QAQDWPPPGQEKPSPHEDIHWGDFTVPWL

SEQ ID NO: 6791 - protein, 22 aa, Canis lupus familiaris
QAQRLHHGQVAPRLRSLHRRGL

SEQ ID NO: 6792 - protein, 37 aa, Canis lupus familiaris
QARPREERVWRARRPDPGQVGPRHQQRLPHHPGQEEL

SEQ ID NO: 6793 - protein, 27 aa, Canis lupus familiaris
QARVPCAAVPGGGADTDGLHHVRRLAL

SEQ ID NO: 6794 - protein, 8 aa, Canis lupus familiaris
QARVTGGC

SEQ ID NO: 6795 - protein, 13 aa, Canis lupus familiaris
QAWCPPENSRAPL

SEQ ID NO: 6796 - skipped

SEQ ID NO: 6797 - protein, 21 aa, Canis lupus familiaris
QCCLCRTQPERVSGVKSKTKR

SEQ ID NO: 6798 - protein, 18 aa, Canis lupus familiaris
QCLPCSYPCCQPYPAGQL

SEQ ID NO: 6799 - protein, 20 aa, Canis lupus familiaris
QCLRRKNELFTIYHTSFNGI

SEQ ID NO: 6800 - protein, 25 aa, Canis lupus familiaris
QCPGPARQATPLLPRPSRAQCSVLW

SEQ ID NO: 6801 - protein, 29 aa, Canis lupus familiaris
QCTSETQCQRCPGPHVEAQARTTSGCDPS

SEQ ID NO: 6802 - protein, 21 aa, Canis lupus familiaris
QCWCPSAVPWLQLRGHWPDGG

SEQ ID NO: 6803 - protein, 29 aa, Canis lupus familiaris
QCWPYRGALQCWCWTDWLLHRDRHHAGHG

SEQ ID NO: 6804 - protein, 11 aa, Canis lupus familiaris
QDPRRGTCGLR

SEQ ID NO: 6805 - skipped

SEQ ID NO: 6806 - protein, 17 aa, Canis lupus familiaris
QEADRQWQRQRQQLQRL

SEQ ID NO: 6807 - protein, 8 aa, Canis lupus familiaris
QEKELRDI

SEQ ID NO: 6808 - protein, 41 aa, Canis lupus familiaris
QELPGGERKSHCLLRFPQGPLFKRELQVSSSSNTFKNSTRN

SEQ ID NO: 6809 - protein, 19 aa, Canis lupus familiaris
QEQPRDSVRDQPLCRRRLL

SEQ ID NO: 6810 - protein, 40 aa, Canis lupus familiaris
QERAALSASPGPAAAASYHPHCATPASCWSLWAGRCAGGG

SEQ ID NO: 6811 - protein, 20 aa, Canis lupus familiaris
QFIQQCDPQVHSPWGIHCVC

SEQ ID NO: 6812 - protein, 18 aa, Canis lupus familiaris
QGAARGAAGLPATVPPCR

SEQ ID NO: 6813-6815 - skipped (3 entries)

SEQ ID NO: 6816 - protein, 32 aa, Canis lupus familiaris
QGLCCLEAPPASHSPTGNLWTSGPQSPDSGWH

SEQ ID NO: 6817 - protein, 71 aa, Canis lupus familiaris
QGLVEAGELHRPDQEPCPHRLLYRGSAVLPGDWPTRRRHGGLRRRECRAGDQGMAVWRQRGGPAMLADCPH

SEQ ID NO: 6818 - protein, 38 aa, Canis lupus familiaris
QGPKAAAAARGERASRAGGFGPWAAGRRERAALGTASF

SEQ ID NO: 6819 - protein, 25 aa, Canis lupus familiaris
QGPPGRAEQSLVWAQQKQHETPKHR

SEQ ID NO: 6820 - protein, 22 aa, Canis lupus familiaris
QGPVGHRDQGPWAARLQGGPGH

SEQ ID NO: 6821 - protein, 22 aa, Canis lupus familiaris
QGQEPRQAASGPCQASDLQVTC

SEQ ID NO: 6822 - protein, 48 aa, Canis lupus familiaris
QGQPGPRQSPGPSQGQVRGLLPGVEQGQLFQKPHPQATEDLEKLSEHE

SEQ ID NO: 6823 - protein, 8 aa, Canis lupus familiaris
QGRAGPEW

SEQ ID NO: 6824 - protein, 19 aa, Canis lupus familiaris
QGSCTLQDRRLSGIQTYPR

SEQ ID NO: 6825 - protein, 41 aa, Canis lupus familiaris
QGSLGVGLGAGRGHVGRGRSGTPTRAPAPEPQGGLLLGARK

SEQ ID NO: 6826 - protein, 19 aa, Canis lupus familiaris
QGTSERGGESAGALCSAAG

SEQ ID NO: 6827 - protein, 13 aa, Canis lupus familiaris
QGVGPSSPRPPDF

SEQ ID NO: 6828 - protein, 8 aa, Canis lupus familiaris
QHGGCPFG

SEQ ID NO: 6829 - protein, 25 aa, Canis lupus familiaris
QHLPRSPRKLDNLISRVTTSDPPTN

SEQ ID NO: 6830 - protein, 15 aa, Canis lupus familiaris
QHLSVRKERGRRHQV

SEQ ID NO: 6831 - protein, 20 aa, Canis lupus familiaris
QHPGDEEHHSCRRTGHPHQL

SEQ ID NO: 6832 - skipped

SEQ ID NO: 6833 - protein, 25 aa, Canis lupus familiaris
QHPNYPKPAQPHTCRPSWPLQQPCQ

SEQ ID NO: 6834 - protein, 56 aa, Canis lupus familiaris
QHPQPAETLTTAACPCLPGSQIHSQRCAAPQAVASRVHVLPCFLPTLAPLCGHQDS

SEQ ID NO: 6835 - protein, 23 aa, Canis lupus familiaris
QHTGPSASGQRRAPRENQPRIPL

SEQ ID NO: 6836 - protein, 17 aa, Canis lupus familiaris
QHVWKRRPLCWSHHYSE

SEQ ID NO: 6837 - protein, 24 aa, Canis lupus familiaris
QHWHCCHPRGHFRRGGHQGCPRER

SEQ ID NO: 6838 - protein, 12 aa, Canis lupus familiaris
QIHHCKSNRENP

SEQ ID NO: 6839 - protein, 32 aa, Canis lupus familiaris
QIPQQAVTSPPRHLLRHQSGPRAAGPIPAQLL

SEQ ID NO: 6840 - protein, 26 aa, Canis lupus familiaris
QIYILPSATEPRADAPGQAHYLHEGL

SEQ ID NO: 6841 - protein, 24 aa, Canis lupus familiaris
QLACGSVRVQHHHGGAARGREWHV

SEQ ID NO: 6842 - skipped

SEQ ID NO: 6843 - protein, 25 aa, Canis lupus familiaris
QLAQACPSAAPTAPATRFAALFSAR

SEQ ID NO: 6844 - skipped

SEQ ID NO: 6845 - protein, 29 aa, Canis lupus familiaris
QLETSRSVSRFKCHGCYPSSQMVFRGLKF

SEQ ID NO: 6846 - protein, 15 aa, Canis lupus familiaris
QLGAPGPAPSRGPGG

SEQ ID NO: 6847 - protein, 27 aa, Canis lupus familiaris
QLHCPAGPPPPPPAGTQRLRRGRAVWA

SEQ ID NO: 6848 - protein, 17 aa, Canis lupus familiaris
QLPRGLPGRERRAGHRS

SEQ ID NO: 6849 - protein, 25 aa, Canis lupus familiaris
QLPVVPPRPPVFPGPHQHPEGLPGI

SEQ ID NO: 6850 - protein, 14 aa, Canis lupus familiaris
QLPVWGGQPPSRGL

SEQ ID NO: 6851 - protein, 8 aa, Canis lupus familiaris
QLSSPEKQ

SEQ ID NO: 6852 - protein, 10 aa, Canis lupus familiaris
QNICDPPSHL

SEQ ID NO: 6853 - protein, 85 aa, Canis lupus familiaris
QPGLQGLPRVHRREPAPRESLPVRPAPQRRDWLPDSHVREAVPYCPGNAAQRDRLGSGHWRISRGKGESRAGGDPGEGPGDVQHG

SEQ ID NO: 6854 - skipped

SEQ ID NO: 6855 - protein, 77 aa, Canis lupus familiaris
QPPGLRAGQRARLRLLHDLRPGRGAVVRRLHGALRPGAALPPPAGRGEAAARPAARPRGLPQREELPRASQDRERLP

SEQ ID NO: 6856 - protein, 20 aa, Canis lupus familiaris
QPQAGSRGTREESSICHPGP

SEQ ID NO: 6857 - protein, 8 aa, Canis lupus familiaris
QPQHCGAS

SEQ ID NO: 6858 - skipped

SEQ ID NO: 6859 - protein, 24 aa, Canis lupus familiaris
QPRGHGLLSACGLAGSQPDGKASE

SEQ ID NO: 6860 - protein, 37 aa, Canis lupus familiaris
QPRPLHLSRAGLRRELHRPADVYRVPGHLHSHGRDPA

SEQ ID NO: 6861 - protein, 17 aa, Canis lupus familiaris
QPSPEARAAAGERRTGV

SEQ ID NO: 6862 - protein, 24 aa, Canis lupus familiaris
QPTLRAQPPPGQLPAGLPAPRHGL

SEQ ID NO: 6863 - protein, 67 aa, Canis lupus familiaris
QQAPRPGPARRRRPQQEAAAFQGRRRGGPGPLCRHRPGGHPPWGGRQPLREPAGAPRGPGWGRTQVL

SEQ ID NO: 6864 - skipped

SEQ ID NO: 6865 - protein, 29 aa, Canis lupus familiaris
QQHKAGHLPQGVCLHPRPYWAQRPEERLC

SEQ ID NO: 6866 - protein, 20 aa, Canis lupus familiaris
QQHPGAGPAGVPGPGGGHAL

SEQ ID NO: 6867 - protein, 22 aa, Canis lupus familiaris
QQNISPTTAASCDLNGAPSCHF

SEQ ID NO: 6868 - protein, 19 aa, Canis lupus familiaris
QQPHPWLPGSYSRIFLVCL

SEQ ID NO: 6869 - protein, 34 aa, Canis lupus familiaris
QQPLQPVCEPLPCGLSWCSGGGAAPHSLRRGLRV

SEQ ID NO: 6870 - protein, 34 aa, Canis lupus familiaris
QQPLRGLCRHLLPGLLRTQRTPAVPRELCRGLPV

SEQ ID NO: 6871 - protein, 8 aa, Canis lupus familiaris
QQQQGEGL

SEQ ID NO: 6872 - protein, 20 aa, Canis lupus familiaris
QQRPVRRGVLTASQRHLPLL

SEQ ID NO: 6873 - protein, 11 aa, Canis lupus familiaris
QQTWNRCPCPH

SEQ ID NO: 6874 - protein, 23 aa, Canis lupus familiaris
QQWGEKAGDQRGEARGQHGKDGS

SEQ ID NO: 6875 - protein, 34 aa, Canis lupus familiaris
QRDHAAPHHSQGFDRQSHHGPGPCHPPSPQGRAA

SEQ ID NO: 6876 - protein, 43 aa, Canis lupus familiaris
QRERGPGGSALQLHQPRALPAQQHPAHLRTANCAPQGSRRGVL

SEQ ID NO: 6877 - protein, 10 aa, Canis lupus familiaris
QRGLQRGCDV

SEQ ID NO: 6878 - skipped

SEQ ID NO: 6879 - protein, 67 aa, Canis lupus familiaris
QRPAAGPAACGGNPALGKHQLLRRWELRPGGECGPAGLPRLPAGHRQHTAAGEAHQPQDGQSLGRTQ

SEQ ID NO: 6880 - protein, 38 aa, Canis lupus familiaris
QRPQLGGGSASPGAWAARDRGQRAATQDQELHLQNCTI

SEQ ID NO: 6881 - protein, 8 aa, Canis lupus familiaris
QRQCTSSV

SEQ ID NO: 6882 - protein, 98 aa, Canis lupus familiaris
QRRAALPAALPLHRRAPSGRRRRPHHRPRPAPALPRLCSEAIGERPEPWAFRLHLHPPAHRQAPGPQLAPGPGPGRAGAGSGLPGALPVPHACAQPRR

SEQ ID NO: 6883 - protein, 20 aa, Canis lupus familiaris
QRRPQIRGCARPAGAADRRR

SEQ ID NO: 6884 - protein, 71 aa, Canis lupus familiaris
QRRQEQPGEPTQPEACVHSVAGAGDHPRRAGDPRGPGWVPRAAERHGGVAGGRGAGGAGGRAARPPEAGAG

SEQ ID NO: 6885 - skipped

SEQ ID NO: 6886 - protein, 26 aa, Canis lupus familiaris
QRWNSLPILPVQQDGAGRWPPDMVGL

SEQ ID NO: 6887 - protein, 14 aa, Canis lupus familiaris
QSGADGHPLPRGMH

SEQ ID NO: 6888 - protein, 65 aa, Canis lupus familiaris
QSLAAWRSEDARLRCPPECDRVYLNYPPFNGGHPAAQPAPGPEQHRAPDQPVLPDEGRHQHYLSV

SEQ ID NO: 6889 - protein, 20 aa, Canis lupus familiaris
QSMSPDSSHTPGSCRACLAQ

SEQ ID NO: 6890 - protein, 9 aa, Canis lupus familiaris
QSQEACPHS

SEQ ID NO: 6891 - protein, 59 aa, Canis lupus familiaris
QSRQPRPQGLQLEKVQVHRAKLSGLPSREPGRGEEFWSTLPPSPAPQWRRGFQQQWQRQ

SEQ ID NO: 6892 - protein, 65 aa, Canis lupus familiaris
QSSRAVGATPPYPRAARTPPPRRAGLRELPHRPGPRGLPPLSRAAGTPPPPVVQGRGSHPRHPGP

SEQ ID NO: 6893 - protein, 27 aa, Canis lupus familiaris
QTLCPWRPLPEPISWTRDLPVCTWLPG

SEQ ID NO: 6894 - protein, 23 aa, Canis lupus familiaris
QTPKGRSLTYSAASCCHLPTRPP

SEQ ID NO: 6895 - protein, 39 aa, Canis lupus familiaris
QVASEPLPVLCGGNGGARHPGGPAAGPGPRPGGQCPHGI

SEQ ID NO: 6896 - protein, 33 aa, Canis lupus familiaris
QVHILRLAVPTARGDVPPHRWAHIPRGDGGDPV

SEQ ID NO: 6897 - protein, 8 aa, Canis lupus familiaris
QVQLLSGT

SEQ ID NO: 6898 - skipped

SEQ ID NO: 6899 - protein, 41 aa, Canis lupus familiaris
QVRARPQKDQGGEPRGAACPRSPLPHPGLRRDCQGGQDIQV

SEQ ID NO: 6900 - protein, 15 aa, Canis lupus familiaris
QVRHQLSQGQCPGLQ

SEQ ID NO: 6901 - skipped

SEQ ID NO: 6902 - protein, 15 aa, Canis lupus familiaris
QVSSRLHILPGYPIL

SEQ ID NO: 6903 - protein, 34 aa, Canis lupus familiaris
RAAAPGAPPPARWGLWARGAGARCWAGGAWGEEL

SEQ ID NO: 6904 - protein, 27 aa, Canis lupus familiaris
RAACHRRPFLLGGGGILRAYSPGGPAI

SEQ ID NO: 6905 - protein, 33 aa, Canis lupus familiaris
RAAPASSRPHPRLQPSRLLEPLQVFRAGCGLGE

SEQ ID NO: 6906 - protein, 19 aa, Canis lupus familiaris
RAAPGPRRPGHELRQRGGA

SEQ ID NO: 6907 - protein, 79 aa, Canis lupus familiaris
RAGLRQLLGRGLRCDPSRGPRGSCLHLVAAGPHSAPSRSAAPIRQQHPSVPSPRLTRPGSGSSARVVGRCIFFKQQQPE

SEQ ID NO: 6908 - protein, 25 aa, Canis lupus familiaris
RAGRPQPHPRRSHPDHCMGGQRDRL

SEQ ID NO: 6909 - protein, 16 aa, Canis lupus familiaris
RALPAAPGRPGRCSAP

SEQ ID NO: 6910 - protein, 47 aa, Canis lupus familiaris
RALPRVPGLTAAQPGLQALPLLLRHGAAGRPLRGPGRRPGRRHVEPV

SEQ ID NO: 6911 - protein, 93 aa, Canis lupus familiaris
RAPAPRLLPGLRLRRGRGPRGRRRGGAPGRGLRRAAPRATRVLAQDSPGPGPGLRLAFPARPATPQRLLPGPRTGQAPRAGLPERPARSLQRD

SEQ ID NO: 6912 - protein, 9 aa, Canis lupus familiaris
RAPQHPGRL

SEQ ID NO: 6913 - protein, 78 aa, Canis lupus familiaris
RAPSVPPGQGHRAAGGALPGQQQDPALRPLQQRHQGPLSGSHGPFLAPGGVQLRLLQDLPGGRVLRGGAEQRLLRALL

SEQ ID NO: 6914 - protein, 43 aa, Canis lupus familiaris
RAPTGLLRHHRSQYHPALPFCLGYCPHGVSHLSLLYLHPGHNL

SEQ ID NO: 6915 - protein, 55 aa, Canis lupus familiaris
RAQPTPAPHSPAGPAAEEAGPACPPIFLHNTPEPALLCHPAAGPRGHGEGLWSRL

SEQ ID NO: 6916-6917 - skipped (2 entries)

SEQ ID NO: 6918 - protein, 61 aa, Canis lupus familiaris
RASGAAGSARTSWREGRDWGRGPDGSPRSPRPPRTLWSSRCRWATRASRWNRQPRCRGREG

SEQ ID NO: 6919 - protein, 48 aa, Canis lupus familiaris
RASWSHGTARTSRCPRSCGPSWSPWTARPTRRARTCWRIVHGQQQLHL

SEQ ID NO: 6920 - protein, 23 aa, Canis lupus familiaris
RATGTRAAGPHPRQLGGPRGRQD

SEQ ID NO: 6921 - protein, 10 aa, Canis lupus familiaris
RATPRTPQPA

SEQ ID NO: 6922 - protein, 13 aa, Canis lupus familiaris
RATRPPGAEGRKR

SEQ ID NO: 6923 - protein, 51 aa, Canis lupus familiaris
RAVGAAIYRQHLLAGGLGRARPRLHEKAEPGVRRDLQFRSWRYISCGFKWL

SEQ ID NO: 6924 - skipped

SEQ ID NO: 6925 - protein, 10 aa, Canis lupus familiaris
RAYGSPEGAL

SEQ ID NO: 6926 - skipped

SEQ ID NO: 6927 - protein, 46 aa, Canis lupus familiaris
RCVYCAAAGRERGRAGALAAGAGRAAEAAAGLTAKAPSCVHPEGSL

SEQ ID NO: 6928 - protein, 98 aa, Canis lupus familiaris
RDAGAGAHWRPRYGQKEPSEGAPGGAGRCGPERAALRGLLALPGLRGPLPRGAAPQPAPRGPRGGGGSAHQTLLRVDRGLHPGLVAGLPVLLGPSGAV

SEQ ID NO: 6929 - protein, 12 aa, Canis lupus familiaris
RDDPTSGRRGLC

SEQ ID NO: 6930 - protein, 23 aa, Canis lupus familiaris
RDKRHQRLPRPQGRRGRSRRPRR

SEQ ID NO: 6931 - protein, 41 aa, Canis lupus familiaris
RDLGHARERAEVPYSGLYGPRPREQQPQHAQKFVWVSHCCC

SEQ ID NO: 6932 - protein, 9 aa, Canis lupus familiaris
RDLGKDFGT

SEQ ID NO: 6933 - protein, 9 aa, Canis lupus familiaris
RDPAVGSPG

SEQ ID NO: 6934 - protein, 42 aa, Canis lupus familiaris
REAVLASPTRHPMPQQLPLLHDLLCERVEPSEPPCGNTRTEP

SEQ ID NO: 6935 - protein, 51 aa, Canis lupus familiaris
REDPVQSHTTQPPPADPPRPVPPRPPQHCRQPRQTREEWACQRPPQDCQDL

SEQ ID NO: 6936 - protein, 12 aa, Canis lupus familiaris
REGARRDCGEAR

SEQ ID NO: 6937 - skipped

SEQ ID NO: 6938 - protein, 22 aa, Canis lupus familiaris
RETPHAAPPQLYELHETHSVAQ

SEQ ID NO: 6939 - protein, 54 aa, Canis lupus familiaris
REVPQWDGNPLPPVRVDDRGLDAGLVGGSVAAEDGCSTQTAWDADPERLPWPRH

SEQ ID NO: 6940 - protein, 12 aa, Canis lupus familiaris
RFPAEPHWCGLC

SEQ ID NO: 6941 - protein, 29 aa, Canis lupus familiaris
RGACPCSRPATHGASWPRPHGSIEQPGPD

SEQ ID NO: 6942 - protein, 47 aa, Canis lupus familiaris
RGAGREPRQGEGGLVRQVPAGATGPRVALPDLRHLREENGSPLCLDK

SEQ ID NO: 6943 - protein, 78 aa, Canis lupus familiaris
RGAGREPRQGEGGLVRQVPAGATGPRVALPDLRHLREENGSPLCLLCWRIKSPSIYTCPFGLLAHFGVWDHTDLGHHL

SEQ ID NO: 6944 - protein, 16 aa, Canis lupus familiaris
RGATGLLLPQVPVSGP

SEQ ID NO: 6945 - protein, 26 aa, Canis lupus familiaris
RGCARACGLPCQSPLHTAGPITRGCH

SEQ ID NO: 6946 - protein, 37 aa, Canis lupus familiaris
RGCSEQPRLCLQPGDQQPELRREQRVLRQLRGTFSHH

SEQ ID NO: 6947 - protein, 14 aa, Canis lupus familiaris
RGEEQDHEPPFPGL

SEQ ID NO: 6948 - protein, 15 aa, Canis lupus familiaris
RGGVPGAAAGGQGVL

SEQ ID NO: 6949 - protein, 67 aa, Canis lupus familiaris
RGHQDRRRPRAPAAGRHPAQPHLPSLQRQAGRHHHLVPGRDAAGGRRGQHGTAEGRQERDHRQPAAH

SEQ ID NO: 6950 - protein, 20 aa, Canis lupus familiaris
RGHRTEPESHPPIPRSAAAQ

SEQ ID NO: 6951 - skipped

SEQ ID NO: 6952 - protein, 77 aa, Canis lupus familiaris
RGLPQRRRQQQRRRQQQRGGAWRRREQLVPARPRARDPRTRRRRGPRRTPGGDAAPGRQVENQVHHRHVQRPSGPQL

SEQ ID NO: 6953-6954 - skipped (2 entries)

SEQ ID NO: 6955 - protein, 8 aa, Canis lupus familiaris
RGPAAPCP

SEQ ID NO: 6956 - protein, 79 aa, Canis lupus familiaris
RGPAWHPQSLRAPSLPGVPEAPRRGAQEGEETAEAGQVHMPVLQPALRQAQRAPEAYPLAHGRAALPLRPLRLLLQDQE

SEQ ID NO: 6957 - protein, 10 aa, Canis lupus familiaris
RGPGHLRTWK

SEQ ID NO: 6958 - protein, 66 aa, Canis lupus familiaris
RGPGLGALRASQPPVRLRPAVLLHGGRQPAPDGRLHRRQHPGPRPRLGRAPLPHTTPRARPVPLAL

SEQ ID NO: 6959 - protein, 12 aa, Canis lupus familiaris
RGPGRARPGCGL

SEQ ID NO: 6960 - protein, 17 aa, Canis lupus familiaris
RGPGTRANRGGPGRGVL

SEQ ID NO: 6961 - protein, 12 aa, Canis lupus familiaris
RGPRPWFRPTAL

SEQ ID NO: 6962 - protein, 48 aa, Canis lupus familiaris
RGQAEPGLPRGTGGARCRGRGRARPGPARGAAGPQRQASSRELGLRAG

SEQ ID NO: 6963 - protein, 12 aa, Canis lupus familiaris
RGQAPGALPAFL

SEQ ID NO: 6964 - protein, 11 aa, Canis lupus familiaris
RGQWSRQQPRP

SEQ ID NO: 6965 - protein, 39 aa, Canis lupus familiaris
RGRAGSRPVHVGASGCRVWPREGRRPGQRDGDQGEGGQA

SEQ ID NO: 6966 - protein, 13 aa, Canis lupus familiaris
RGRATPVPRPDTC

SEQ ID NO: 6967 - skipped

SEQ ID NO: 6968 - protein, 35 aa, Canis lupus familiaris
RGRGTSSRAWLCQLHQAVLRAGVQRRDRTGGRVRG

SEQ ID NO: 6969 - protein, 53 aa, Canis lupus familiaris
RGSPPHLPALGRASPCPGPGTLDPGYRPEVLQKPSGAGRKPQDQDRGSETAGN

SEQ ID NO: 6970 - protein, 16 aa, Canis lupus familiaris
RGYLHHREGNRLVAVE

SEQ ID NO: 6971 - protein, 55 aa, Canis lupus familiaris
RGYLLLPLQGALPGRGPPGHDQHVPPRRRGAGARRPQQTAHVPALPERPGARHGH

SEQ ID NO: 6972 - protein, 13 aa, Canis lupus familiaris
RHCCLPGERGAGV

SEQ ID NO: 6973 - protein, 35 aa, Canis lupus familiaris
RHLRSGLLRALLLRQRHRLLAHRRRLRLQGGLAAW

SEQ ID NO: 6974 - protein, 15 aa, Canis lupus familiaris
RHLWGELWAEVPLSR

SEQ ID NO: 6975 - protein, 13 aa, Canis lupus familiaris
RHQPAPAMQEAML

SEQ ID NO: 6976 - protein, 32 aa, Canis lupus familiaris
RHRPCRGRGQGWGPGGHSPRLCAGHVPGQVVL

SEQ ID NO: 6977 - skipped

SEQ ID NO: 6978 - protein, 22 aa, Canis lupus familiaris
RHWRHPQSPAAPPSGFCSRLSL

SEQ ID NO: 6979 - protein, 18 aa, Canis lupus familiaris
RIPRLRGHGHGPGGVRTL

SEQ ID NO: 6980 - skipped

SEQ ID NO: 6981 - protein, 13 aa, Canis lupus familiaris
RKPLCLQCRPQGL

SEQ ID NO: 6982 - protein, 29 aa, Canis lupus familiaris
RKRAGQQPCGASLTPGAQLHGCTGQRQLL

SEQ ID NO: 6983 - protein, 50 aa, Canis lupus familiaris
RLAAGLPPPLQHQRCRLQRGLRLECCARPHLQPRLEEAVARGHICRRLVF

SEQ ID NO: 6984 - protein, 61 aa, Canis lupus familiaris
RLALQPAAAARRSGSRRRLRERAGAQPHRRLPAAAAGGARACVPGAVHPHRPRAALQGVSY

SEQ ID NO: 6985 - protein, 27 aa, Canis lupus familiaris
RLCHARPAQPGGPRRAEHCLPPRELLQ

SEQ ID NO: 6986 - protein, 23 aa, Canis lupus familiaris
RLCQVCPGLHLQRRLGQVQLLCL

SEQ ID NO: 6987 - protein, 15 aa, Canis lupus familiaris
RLEDREDLPLPVLRV

SEQ ID NO: 6988 - protein, 12 aa, Canis lupus familiaris
RLGQDHVLPGHE

SEQ ID NO: 6989 - protein, 23 aa, Canis lupus familiaris
RLGREPDWPEQGPAPPQCHLCQL

SEQ ID NO: 6990 - protein, 80 aa, Canis lupus familiaris
RLGSSHAVCSLAGLRAQQEQEKEEDRFHSLQRLRADLAPPGKSGRELEDGDGGGPEPRGHQLRRDAEHAEVRRPGQADPL

SEQ ID NO: 6991 - protein, 31 aa, Canis lupus familiaris
RLLHEPLTCVHRLGHLRPLSRSGCLPRGGLL

SEQ ID NO: 6992 - skipped

SEQ ID NO: 6993 - protein, 39 aa, Canis lupus familiaris
RLLRAPGLSPAHTAVCQVPACVRARLGLQGEEARSTVIG

SEQ ID NO: 6994 - protein, 14 aa, Canis lupus familiaris
RLLSPGRHLLQTGA

SEQ ID NO: 6995 - protein, 19 aa, Canis lupus familiaris
RLLYVFSRSEEQGQPTQLP

SEQ ID NO: 6996 - protein, 11 aa, Canis lupus familiaris
RLPPQWGHPHL

SEQ ID NO: 6997 - protein, 21 aa, Canis lupus familiaris
RLVLRTREQPAHSQWLLGGSV

SEQ ID NO: 6998 - protein, 32 aa, Canis lupus familiaris
RMGDAQGRGQRAPLLLQPRHGRDHLGVALRGL

SEQ ID NO: 6999 - protein, 9 aa, Canis lupus familiaris
RNERGGRVV

SEQ ID NO: 7000 - protein, 11 aa, Canis lupus familiaris
RNHRVSWVHRK

SEQ ID NO: 7001 - protein, 31 aa, Canis lupus familiaris
RPAAWNPTLSCHRGQGRLGCSRRGLSGAWAC

SEQ ID NO: 7002 - protein, 40 aa, Canis lupus familiaris
RPAPRPPRPRQGRRFRPRLRRGGEPQHREHLLLDLPHPTG

SEQ ID NO: 7003 - protein, 9 aa, Canis lupus familiaris
RPCRDEAFT

SEQ ID NO: 7004 - skipped

SEQ ID NO: 7005 - protein, 10 aa, Canis lupus familiaris
RPGEQQPLEQ

SEQ ID NO: 7006 - protein, 26 aa, Canis lupus familiaris
RPGPARGTGSHDGGGLDGPCAGICDL

SEQ ID NO: 7007 - skipped

SEQ ID NO: 7008 - protein, 21 aa, Canis lupus familiaris
RPIAVPSTSPRTLVCPWLSWL

SEQ ID NO: 7009 - protein, 100 aa, Canis lupus familiaris
RPLAAGAPAGAQPAPLACQAALLAADLPAGPPEGHLRQVRGAPRRAPVGVWAAWPGGAAPRGALPPGAGSGSGPREPPGAEAAQGAVSAEQCQQGAGQRD

SEQ ID NO: 7010 - protein, 52 aa, Canis lupus familiaris
RPLAPGVPRLPPVWPRGALRPLPAQDQEPEGARWAAADKGDRLLRVCAVQGV

SEQ ID NO: 7011 - protein, 11 aa, Canis lupus familiaris
RPLGAPSGSPG

SEQ ID NO: 7012 - protein, 33 aa, Canis lupus familiaris
RPLPDVPAGPSLTQELQGEDDHEDVGPAQLGIS

SEQ ID NO: 7013 - protein, 8 aa, Canis lupus familiaris
RPPCGIIH

SEQ ID NO: 7014 - skipped

SEQ ID NO: 7015 - protein, 55 aa, Canis lupus familiaris
RPPGQGAADVFHREVRGRERELAAGQRADGRALPAVRRLRPRRGQALRVPGPVGQ

SEQ ID NO: 7016 - protein, 13 aa, Canis lupus familiaris
RPPLFPPCAVQPL

SEQ ID NO: 7017 - protein, 67 aa, Canis lupus familiaris
RPPPPAPRLPTRSPFAKGAAPWSADKGPWSVAGSGVPARGPGPRATLAAQLRQDGGLVFAAVYQPQK

SEQ ID NO: 7018 - protein, 19 aa, Canis lupus familiaris
RPPRETWSPWSCRCHRKSC

SEQ ID NO: 7019 - protein, 49 aa, Canis lupus familiaris
RPPRPPRKVWTGRNEGRRRTHREPRREGGERGDGTGRRTGRERRARGEG

SEQ ID NO: 7020 - protein, 82 aa, Canis lupus familiaris
RPPRPPRKVWTGRNEGRRRTHREPRREGGERGDGTGRRTGSRRPNWGERRTRWPRETRSNRIARPYRAPGIYRRERRARGEG

SEQ ID NO: 7021 - protein, 57 aa, Canis lupus familiaris
RPPSGSSGQIPAAPRGISPAARPPASPTAGQPRLGPPSGISAPPAPRSAHQRLRMGD

SEQ ID NO: 7022 - protein, 89 aa, Canis lupus familiaris
RPPWPSRQPGLPSKQPPGRPLLPAASDGQGRRRLTAGFCCCGHSAGRRPRAPGPPRPSRSPWATWSPRTPRCTRISGPGWRAGHDGTSW

SEQ ID NO: 7023 - protein, 13 aa, Canis lupus familiaris
RPPWSSRHRWHRR

SEQ ID NO: 7024 - protein, 19 aa, Canis lupus familiaris
RPQGCGENPAPAAPPTTPQ

SEQ ID NO: 7025 - protein, 79 aa, Canis lupus familiaris
RPRALRLPVSDPPLRSAARGPQVGGQPLCRARGSPLWEPTSLRGWRTAAQGRGSHARGWGLVSGQGLAARGPSLCLTLI

SEQ ID NO: 7026 - protein, 40 aa, Canis lupus familiaris
RPRGPGGEERRPRRDGPRWSLRRSWSCRLPRPPWSPRSTR

SEQ ID NO: 7027 - protein, 67 aa, Canis lupus familiaris
RPRPAAASRARGRRDAGAPQRASGLGPRAAGDARRAEPRQAPPGAEGSGGRAPGGQRAGDSPWTPSS

SEQ ID NO: 7028 - protein, 28 aa, Canis lupus familiaris
RPRPPHHRDPQHHTWGALPSPHLGPALE

SEQ ID NO: 7029 - skipped

SEQ ID NO: 7030 - protein, 22 aa, Canis lupus familiaris
RPSGPPWWQWRQSDGSLPWHAE

SEQ ID NO: 7031 - protein, 14 aa, Canis lupus familiaris
RPSRLAGSSWAKRC

SEQ ID NO: 7032 - protein, 34 aa, Canis lupus familiaris
RPSRSPWATWSPRTPRCTRISGPGWRAGHDGTSW

SEQ ID NO: 7033 - protein, 43 aa, Canis lupus familiaris
RPTRPRGISRGERPGWCRWAHRNPRETWAPRTSRAGWRERSSW

SEQ ID NO: 7034 - protein, 10 aa, Canis lupus familiaris
RPVVPSGPDP

SEQ ID NO: 7035 - protein, 26 aa, Canis lupus familiaris
RPWHPGPLTASRSTSSPHTTQQELLR

SEQ ID NO: 7036 - protein, 26 aa, Canis lupus familiaris
RPWTGLQVPLGTLPTFFCATVPAASR

SEQ ID NO: 7037 - protein, 25 aa, Canis lupus familiaris
RQGQVAPPAQHAKAGHPLGRHQVPP

SEQ ID NO: 7038 - protein, 22 aa, Canis lupus familiaris
RQHPGPALLGARGGREGILPLQ

SEQ ID NO: 7039 - protein, 8 aa, Canis lupus familiaris
RQHQAPKA

SEQ ID NO: 7040 - skipped

SEQ ID NO: 7041 - protein, 21 aa, Canis lupus familiaris
RRAAHPPAPEERLDLEPDAHR

SEQ ID NO: 7042 - protein, 59 aa, Canis lupus familiaris
RRAARAGRHLPAPERAHRGLAAVPALPWPGCTPHAGCQPTGPRLRPCGHLLGSSPRAAR

SEQ ID NO: 7043 - protein, 44 aa, Canis lupus familiaris
RRAGLRELPHRPGPRGLPPLSRAAGTPPPPVVQGRGSHPRHPGP

SEQ ID NO: 7044 - protein, 16 aa, Canis lupus familiaris
RRAGQVLARPRATLQG

SEQ ID NO: 7045 - protein, 44 aa, Canis lupus familiaris
RRAQALPQTLHGRAHAHAHAHALTHALARGGQGPPAPAHPLPVL

SEQ ID NO: 7046 - protein, 92 aa, Canis lupus familiaris
RRGALIPSTACSCSASSSTFFLLLLLFLLLSFWAFLSRLSVLSLLQRLLSASWEPLLLAAAPSLPGEQGGGLWWEAAVYPLLHSSGAGQPAL

SEQ ID NO: 7047 - protein, 25 aa, Canis lupus familiaris
RRGRQRGLQEHLLRHHAWRRQGPGV

SEQ ID NO: 7048 - protein, 82 aa, Canis lupus familiaris
RRHPGGHRQPESPHSPEPANRPHHPEGEDGGARADQDPQQQVRLLHRQGALPGATEQGPGHQVDSAPGAGHQDREAEPGAPV

SEQ ID NO: 7049 - protein, 18 aa, Canis lupus familiaris
RRKAMLPAHYFCDWICRQ

SEQ ID NO: 7050 - protein, 16 aa, Canis lupus familiaris
RRKRGSPVLPPQTWQF

SEQ ID NO: 7051 - protein, 29 aa, Canis lupus familiaris
RRLFHGHAAQQTLSAPGVPGAAPALRPGF

SEQ ID NO: 7052 - protein, 24 aa, Canis lupus familiaris
RRLHGAQGLEGADRLLRLPGEARL

SEQ ID NO: 7053 - protein, 54 aa, Canis lupus familiaris
RRLPGAGRAQGRPLCRLSPREREERRGPDLPEVPGGRPAVWKPGQPAVAGEGPA

SEQ ID NO: 7054 - protein, 67 aa, Canis lupus familiaris
RRPHRTRHPPPRTPDQHPEPRGGGVRRDHQQPHEARVHGREGLRQGLGHQPPRQQEPRLSARLSEQG

SEQ ID NO: 7055 - protein, 61 aa, Canis lupus familiaris
RRPHRTRHPPPRTPDQHPEPRGGGVRRDHQQPHEARVHRREGLRQGLGHQPPRQQEPRLSA

SEQ ID NO: 7056 - protein, 34 aa, Canis lupus familiaris
RRPPHPLPARRPGHAVLGGLVRAPRHQQQHRHWP

SEQ ID NO: 7057 - protein, 29 aa, Canis lupus familiaris
RRRHAGGHPPRGAAPQDRHQRQVGAPHLV

SEQ ID NO: 7058 - skipped

SEQ ID NO: 7059 - protein, 65 aa, Canis lupus familiaris
RRRPGARAPRPPARARLPVLAQRPPPAGRVGPLVHHLCLLCGILGIRLPGSASAGVPPGPLLPIR

SEQ ID NO: 7060 - protein, 56 aa, Canis lupus familiaris
RRRPPPAPAPVASLCHRGLHHVHLPPPLPPSLDGLPISESIRCSLRLLLGKRQSLS

SEQ ID NO: 7061 - protein, 98 aa, Canis lupus familiaris
RRRPRLPAARPRAPGAPGPRGAGPGRGAGRGQCLGGRAPARRPRARAARRAAAEKKNRLTAPRPPRRRLRRLPGLLSRPVLGVPRPRHVVCRGREQPL

SEQ ID NO: 7062 - protein, 54 aa, Canis lupus familiaris
RRRPRTRRDLRDPAAALGPADTPGPPAAAPLPRTPRPEVAAPRAPSSWETPRLG

SEQ ID NO: 7063 - protein, 20 aa, Canis lupus familiaris
RRRQDQLPVHAVPGAAPQLH

SEQ ID NO: 7064 - protein, 23 aa, Canis lupus familiaris
RRRQWLWTRSEPQRARIPPVPTL

SEQ ID NO: 7065 - protein, 9 aa, Canis lupus familiaris
RRRRAQPAG

SEQ ID NO: 7066 - protein, 19 aa, Canis lupus familiaris
RRRRGPSGPGAWPGRCPRM

SEQ ID NO: 7067 - skipped

SEQ ID NO: 7068 - protein, 76 aa, Canis lupus familiaris
RRSPPVSCSVSILSGRVRRRCGGVCRLPTGDLASALLHLRKTGRGRMGVLWARRRMANPGCSSCRLIPVQACLENL

SEQ ID NO: 7069 - protein, 11 aa, Canis lupus familiaris
RRTEPQLAHRV

SEQ ID NO: 7070 - protein, 18 aa, Canis lupus familiaris
RRTGQLLSTDADRDGAWE

SEQ ID NO: 7071 - skipped

SEQ ID NO: 7072 - protein, 39 aa, Canis lupus familiaris
RSAHTPDPTTQGGSLLEPWRLSGERGAGGAPGPGHRGRR

SEQ ID NO: 7073 - protein, 55 aa, Canis lupus familiaris
RSAPPGTSERPSGGPASRAPSSFSTRAPGAGGATAPSIRAAAERPRGGVGGALGR

SEQ ID NO: 7074 - protein, 9 aa, Canis lupus familiaris
RSCSQSGEN

SEQ ID NO: 7075 - protein, 22 aa, Canis lupus familiaris
RSGRAPRRSRACGSPRSPGCQR

SEQ ID NO: 7076 - protein, 17 aa, Canis lupus familiaris
RSIHQDGPKFQSFLTMS

SEQ ID NO: 7077 - protein, 25 aa, Canis lupus familiaris
RSPASGPRQWLCGAQRLSPSGHVPK

SEQ ID NO: 7078 - protein, 14 aa, Canis lupus familiaris
RSPRATWEAGQGWH

SEQ ID NO: 7079 - protein, 82 aa, Canis lupus familiaris
RSPRNAGVQGAHRLQRRSRRGRQGRREGRSWPPWARWRPWLCGAAGASGTPRSARAGWAPRGSGSHRIPRAARDPRSPRESG

SEQ ID NO: 7080 - protein, 25 aa, Canis lupus familiaris
RSQLPAGSQGLRTRASHGQVCQDPL

SEQ ID NO: 7081 - protein, 11 aa, Canis lupus familiaris
RSQSYCLWSED

SEQ ID NO: 7082 - protein, 30 aa, Canis lupus familiaris
RSRDPPWPGQSPAGAAEAGCQGPQCRGGFV

SEQ ID NO: 7083 - protein, 11 aa, Canis lupus familiaris
RSSRSRPIPAG

SEQ ID NO: 7084 - protein, 13 aa, Canis lupus familiaris
RSSRYPWVQWNKG

SEQ ID NO: 7085 - protein, 31 aa, Canis lupus familiaris
RTGAANLGAGVGCERGGNERSLYRQQESAPL

SEQ ID NO: 7086 - protein, 40 aa, Canis lupus familiaris
RTGPAWPQRRAWFPRRCRITWTPRLSRPPRTPRHSRTNRL

SEQ ID NO: 7087 - protein, 22 aa, Canis lupus familiaris
RTHGTPGLQGKNRTPWPPRTKG

SEQ ID NO: 7088 - protein, 11 aa, Canis lupus familiaris
RTPRHSRTNRL

SEQ ID NO: 7089 - protein, 59 aa, Canis lupus familiaris
RTRRTPGFTWRDRLPGKTRAPRADGHTWKGWAGWSTRPARTQGPARRQRRRRSAWKTRP

SEQ ID NO: 7090 - protein, 54 aa, Canis lupus familiaris
RTSPCQSCAPGTPRPAIPTSLCLQPFSAQPAPQGAASLAQKRTPSRSPLGSIWS

SEQ ID NO: 7091 - protein, 13 aa, Canis lupus familiaris
RTSRTPRSPRGPP

SEQ ID NO: 7092 - protein, 68 aa, Canis lupus familiaris
RTSYLPSCIPAPKAKVSPAHKPDSGSDAERGSPGPHWRAVAGPAPRWAAGGGPAYPARSALPIGRAGD

SEQ ID NO: 7093 - protein, 22 aa, Canis lupus familiaris
RTTGGSPSPKREAHSWFPARGP

SEQ ID NO: 7094 - skipped

SEQ ID NO: 7095 - protein, 34 aa, Canis lupus familiaris
RVGGGRVSLRGSGSSAGRLTPPAPWRSPPDLCRT

SEQ ID NO: 7096 - protein, 26 aa, Canis lupus familiaris
RVNVLPPRSLQCTCRPGIGAPSTPSL

SEQ ID NO: 7097 - protein, 17 aa, Canis lupus familiaris
RVPRLWHCHPGPQHICG

SEQ ID NO: 7098 - skipped

SEQ ID NO: 7099 - protein, 26 aa, Canis lupus familiaris
RVRCPGLCAAAPPAACGPAAGPQLCW

SEQ ID NO: 7100 - protein, 18 aa, Canis lupus familiaris
RVVSTGAHFPLGAPGRAR

SEQ ID NO: 7101 - protein, 66 aa, Canis lupus familiaris
RVWPSTPGCHLLIAPHMGQLCQCAVGHPGSRHFHSWEAPGPGPDHHHGSCTDLQRRVFLAGAKECI

SEQ ID NO: 7102 - protein, 24 aa, Canis lupus familiaris
RWGGASHPRGSARSWRPHFSQWPQ

SEQ ID NO: 7103 - protein, 15 aa, Canis lupus familiaris
RWRKIFKDGRAYIKH

SEQ ID NO: 7104 - protein, 9 aa, Canis lupus familiaris
HAGPTAGPI

SEQ ID NO: 7105 - protein, 62 aa, Canis lupus familiaris
HASLRTKARPRLPGGELRACQRGAVRALSSWFVPQAPSPPGCCLHLREVRGGSWRLAGGECL

SEQ ID NO: 7106 - protein, 21 aa, Canis lupus familiaris
HFLRFPLCAGAPQDPHAAAES

SEQ ID NO: 7107 - protein, 11 aa, Canis lupus familiaris
HGECLLLAHQE

SEQ ID NO: 7108 - protein, 35 aa, Canis lupus familiaris
HHHLLRLRALHQVHLRLRPAGGRLLSALRDLQDRL

SEQ ID NO: 7109 - protein, 54 aa, Canis lupus familiaris
HLCRPLPAWIMLGQRPHLWAGGAEPQPQLPPLLCATHRLPLRLSPARAAGPRAL

SEQ ID NO: 7110 - protein, 95 aa, Canis lupus familiaris
HLELGGDTLWGRCVSHTRVPGGLCDGTRRTRLGLWGLPGRPGNLSARPSGCGSATSGPAKCPGALRKHRAAAPRGWQGGQRSQQPEHCVVAQGLL

SEQ ID NO: 7111 - protein, 48 aa, Canis lupus familiaris
HLPALGRASPCPGPGTLDPGYRPEVLQKPSGAGRKPQDQDRGSETAGN

SEQ ID NO: 7112 - skipped

SEQ ID NO: 7113 - protein, 58 aa, Canis lupus familiaris
HPDRVLVPHGGRRADPGSELCGGWAAPGHHHVVQAWRQPSHPTPGPRLPPAAAPHVCG

SEQ ID NO: 7114 - protein, 47 aa, Canis lupus familiaris
HPFPVPDHIPQQQPPGLGDPSSQHPGTCESRAGPWRGGWRGQYLSFM

SEQ ID NO: 7115 - protein, 35 aa, Canis lupus familiaris
HPGPLHPDPPYPRSPYPRPPYPHPHHFTHSLREQG

SEQ ID NO: 7116 - skipped

SEQ ID NO: 7117 - protein, 53 aa, Canis lupus familiaris
HPRAYGQGGRSCGPHLGRRPGLRAQRAGDGEPPRGAGAPLEFILEAEAPALGE

SEQ ID NO: 7118 - protein, 8 aa, Canis lupus familiaris
HPRHGRAE

SEQ ID NO: 7119 - protein, 18 aa, Canis lupus familiaris
HPSLATRDQTGACLARPG

SEQ ID NO: 7120 - protein, 15 aa, Canis lupus familiaris
HPTCPTCTPSVPTGR

SEQ ID NO: 7121 - protein, 40 aa, Canis lupus familiaris
HSQFWGLIALSLSLFLPLFPAPRLSLSSPLGGSVVAGLTV

SEQ ID NO: 7122 - protein, 28 aa, Canis lupus familiaris
HTPGPRVLPRPAPWPFRRHRQPASGPHG

SEQ ID NO: 7123 - protein, 15 aa, Canis lupus familiaris
HYSSTTSAICAPYEC

SEQ ID NO: 7124 - protein, 10 aa, Canis lupus familiaris
LASKRPSISD

SEQ ID NO: 7125 - skipped

SEQ ID NO: 7126 - protein, 8 aa, Canis lupus familiaris
LGQSPLCL

SEQ ID NO: 7127 - protein, 39 aa, Canis lupus familiaris
LLGLPIHPTPGLSDSPSHTPMPPGPSWAADRPSDPRAGL

SEQ ID NO: 7128 - protein, 47 aa, Canis lupus familiaris
LLLLLLLLLGELHEEAGGQRPGGLPGEGASAGIQEPDGDRGLLPGND

SEQ ID NO: 7129 - protein, 11 aa, Canis lupus familiaris
LLRQRHQGHQR

SEQ ID NO: 7130 - protein, 18 aa, Canis lupus familiaris
LPAPATDWEAAGSRGYTG

SEQ ID NO: 7131 - protein, 18 aa, Canis lupus familiaris
LPDPSTPTFGGLHPFAHT

SEQ ID NO: 7132 - protein, 33 aa, Canis lupus familiaris
LPGGPFRPELCPLCTDAGQEGRPPPTLGAAALL

SEQ ID NO: 7133 - protein, 10 aa, Canis lupus familiaris
LPPPRRGHCL

SEQ ID NO: 7134 - protein, 14 aa, Canis lupus familiaris
LPSHRPKRRRPQPL

SEQ ID NO: 7135 - protein, 9 aa, Canis lupus familiaris
LRQPELRPQ

SEQ ID NO: 7136 - protein, 48 aa, Canis lupus familiaris
LRVQGTNRDPRRKDIQLLLPRLPLQNCSWHERFGPPSENPHGRQTTQM

SEQ ID NO: 7137 - protein, 18 aa, Canis lupus familiaris
LSRNARGSQNVQVQRLCF

SEQ ID NO: 7138 - protein, 11 aa, Canis lupus familiaris
LVRQRHQGHQR

SEQ ID NO: 7139 - protein, 90 aa, Canis lupus familiaris
PAAAALPAPRGGARVGQGRQAVPERGQHAHARPGRPAAARPDARAGARGALAQPARAARPGGRPGVPGRCGGGLRRRRAGRQPALRQDVV

SEQ ID NO: 7140 - protein, 57 aa, Canis lupus familiaris
PAAATQAGLHGAGGRGRGHPRRPVHAHAHAVGPVSGPRSGPRGACLEHFSLLRRAAV

SEQ ID NO: 7141 - protein, 51 aa, Canis lupus familiaris
PAAPRCRPPQQHRAELRHAGLGEEGAGQPQVPDGPLSGAVRPRPGSPRAAV

SEQ ID NO: 7142 - protein, 44 aa, Canis lupus familiaris
PAARPRCASCSSTCCPPSSWATRCCCSAACASSPRTTASRSSPG

SEQ ID NO: 7143 - protein, 20 aa, Canis lupus familiaris
PAAVTYFGNTSTCTRERCYT

SEQ ID NO: 7144 - protein, 28 aa, Canis lupus familiaris
PACHRVAALWIPTSHLHPVRPLLSTHRP

SEQ ID NO: 7145 - protein, 11 aa, Canis lupus familiaris
PADAPTSRLCL

SEQ ID NO: 7146 - protein, 52 aa, Canis lupus familiaris
PAGAIPPRLRGGGAGRRGAARGPGGRGCPLPRRPHPRRGLGWDLLGIPRLPA

SEQ ID NO: 7147 - protein, 50 aa, Canis lupus familiaris
PAGARAHRRPPAPGRPPARGIPPARRPPALSPAASRSGARAPTNPREQPV

SEQ ID NO: 7148 - skipped

SEQ ID NO: 7149 - protein, 14 aa, Canis lupus familiaris
PAGVRGGLRGLGRG

SEQ ID NO: 7150 - protein, 23 aa, Canis lupus familiaris
PAGVRPRSPPFSPGWVYKSHRSC

SEQ ID NO: 7151 - skipped

SEQ ID NO: 7152 - protein, 17 aa, Canis lupus familiaris
PAIPPTPRPLHSCHRQV

SEQ ID NO: 7153 - protein, 65 aa, Canis lupus familiaris
PALLPAPRRLGPRAQGAGPRAPHAAPAPPEAEPPVRAAPGRAARGRGGVQKSLPVRPGQREDPES

SEQ ID NO: 7154 - protein, 10 aa, Canis lupus familiaris
PALPPPTIPH

SEQ ID NO: 7155-7156 - skipped (2 entries)

SEQ ID NO: 7157 - protein, 23 aa, Canis lupus familiaris
PAPIYWFLPPVVCQSRLFPAPKI

SEQ ID NO: 7158 - skipped

SEQ ID NO: 7159 - protein, 19 aa, Canis lupus familiaris
PAPLLHHCHFGRQDERQQL

SEQ ID NO: 7160 - protein, 20 aa, Canis lupus familiaris
PAPLSSLGKEVDVLKSTCYH

SEQ ID NO: 7161 - protein, 33 aa, Canis lupus familiaris
PAPPAELHGLGPGRAPAPAAPGSRASVPRAPWG

SEQ ID NO: 7162 - protein, 8 aa, Canis lupus familiaris
PAPPAGAT

SEQ ID NO: 7163 - protein, 28 aa, Canis lupus familiaris
PAPPPPPPAAPGCPGSDLRLRRETSPGT

SEQ ID NO: 7164 - protein, 17 aa, Canis lupus familiaris
PAPPREGPCAPRDLAPK

SEQ ID NO: 7165 - protein, 35 aa, Canis lupus familiaris
PAPPRPGSFPPRGPPARRPRRCCPASLRAKPNRSL

SEQ ID NO: 7166 - protein, 18 aa, Canis lupus familiaris
PAPRPRSGPGAPHRQPAG

SEQ ID NO: 7167 - protein, 15 aa, Canis lupus familiaris
PAPRRAISGGGVLPH

SEQ ID NO: 7168 - skipped

SEQ ID NO: 7169 - protein, 83 aa, Canis lupus familiaris
PAPTAQAAQRQLPGGAGVQPAPLPGIPQSPHEEQPSVHGHAADGAGRGEAGPTLLDHRGVHEERGRQGQADCPGPADARIFKP

SEQ ID NO: 7170 - protein, 47 aa, Canis lupus familiaris
PAPTRAASPGSWSCWASRTCPRCGRCSPRSSWPCSCSRCWATRSSCC

SEQ ID NO: 7171 - protein, 47 aa, Canis lupus familiaris
PAPTRAASPVSWSCWASRTCPRCGRCSPRSSWPCSCSRCWATRSSCC

SEQ ID NO: 7172 - skipped

SEQ ID NO: 7173 - protein, 38 aa, Canis lupus familiaris
PAPVLWSRRDRPTTTQNCQQSPWAAWSRPWVTAAAWQW

SEQ ID NO: 7174 - protein, 12 aa, Canis lupus familiaris
PAQKTRHQDLMS

SEQ ID NO: 7175 - protein, 26 aa, Canis lupus familiaris
PAQPGRCPSPRRTSPSPPRSSSAPSS

SEQ ID NO: 7176 - protein, 81 aa, Canis lupus familiaris
PARAPSRGPWHPPAPVTRPSPAPQQRASHPTTPARTSLRRPPRPRTCIGKRLKVNPFPSRNWSSVLWVTMVAATAPTEWSP

SEQ ID NO: 7177 - protein, 13 aa, Canis lupus familiaris
PARGCPARAPAAT

SEQ ID NO: 7178 - protein, 21 aa, Canis lupus familiaris
PARGSARAPPRPPPVVPPDRA

SEQ ID NO: 7179 - protein, 53 aa, Canis lupus familiaris
PARGTPSGAGPGSGAPRGRAPGSPGPGGRKLWGVNGKKWVVRALRLPLTSLPK

SEQ ID NO: 7180 - protein, 18 aa, Canis lupus familiaris
PARPVAPPGLRGAGGHQA

SEQ ID NO: 7181 - protein, 35 aa, Canis lupus familiaris
PARRDPCSCSRSSTEPPAASWARVWTCSTASPWWS

SEQ ID NO: 7182 - protein, 8 aa, Canis lupus familiaris
PASATVAP

SEQ ID NO: 7183 - protein, 8 aa, Canis lupus familiaris
PASWWFSI

SEQ ID NO: 7184 - protein, 41 aa, Canis lupus familiaris
PATLARSFGRYTSKDFATSFSSDSFLSLLTYFSYWPDVPLM

SEQ ID NO: 7185 - protein, 14 aa, Canis lupus familiaris
PATVGLPAFSFRFH

SEQ ID NO: 7186 - protein, 14 aa, Canis lupus familiaris
PAVFLAYPQPRYVP

SEQ ID NO: 7187 - protein, 13 aa, Canis lupus familiaris
PAWHGGHCPTHSQ

SEQ ID NO: 7188 - protein, 17 aa, Canis lupus familiaris
PAWPHALCSPRPPSRPA

SEQ ID NO: 7189 - protein, 33 aa, Canis lupus familiaris
PCASPASPSRLRWRPRGLPPGPPTPGPQAPWRT

SEQ ID NO: 7190 - protein, 21 aa, Canis lupus familiaris
PCCMWTPCQWEAQWVPGVCGR

SEQ ID NO: 7191 - protein, 64 aa, Canis lupus familiaris
PCECRWHLHVSRFLPSSRPPPTHGLLSTRALPTGAVPWPWGPYCHSPGSFGGCHHGDSTTRRDL

SEQ ID NO: 7192 - protein, 33 aa, Canis lupus familiaris
PCFKKTFYIRLNTCLCRLSSKKERLAVSSTLMD

SEQ ID NO: 7193 - protein, 22 aa, Canis lupus familiaris
PCHPCSLLWSLHLQGLRNQFLL

SEQ ID NO: 7194 - protein, 81 aa, Canis lupus familiaris
PCMSSSGCALDSYFPSSSSSASTLHASTLITWGESGCRRGRLSRLRASGRKTRAGTSAECSSWTSTALKTTLPTAPGCTSP

SEQ ID NO: 7195 - protein, 54 aa, Canis lupus familiaris
PCPGAVESQGQTHHDSELSAEPLGSLVETVGHRRSLAVVRALHMAHVAWHLLPL

SEQ ID NO: 7196 - protein, 23 aa, Canis lupus familiaris
PCPPAQHKIQRFIYQLSAKRSRQ

SEQ ID NO: 7197 - protein, 27 aa, Canis lupus familiaris
PCPPVPATAPGSLGPGGLRGAGAGPWG

SEQ ID NO: 7198 - protein, 52 aa, Canis lupus familiaris
PCRTARLTAMTSAGTSSSTWPMWVLSLTGASSRSGPTGCWSSSRPGSQLGKA

SEQ ID NO: 7199 - protein, 28 aa, Canis lupus familiaris
PCSATRACLRRLWGGCGRAQGSVSGMGR

SEQ ID NO: 7200 - protein, 15 aa, Canis lupus familiaris
PCSLCSLPWGGGWNT

SEQ ID NO: 7201 - protein, 16 aa, Canis lupus familiaris
PCSLPCLSTAPVRPLS

SEQ ID NO: 7202 - protein, 13 aa, Canis lupus familiaris
PCSRGRGCAPATS

SEQ ID NO: 7203 - protein, 22 aa, Canis lupus familiaris
PCSSEMPSSSTTSCRTSACWTW

SEQ ID NO: 7204 - protein, 41 aa, Canis lupus familiaris
PCWAHSRPYLTGPALWSYISPSTSYSSGMRSYPWTTGRPSY

SEQ ID NO: 7205 - protein, 70 aa, Canis lupus familiaris
PCWGRVRVGLARRCELWRGHAPGWSWGSAARPGRGDRCSTSGAAHHLVDAAICLDGPKCPGRVVLAGSPH

SEQ ID NO: 7206 - protein, 35 aa, Canis lupus familiaris
PDAQHSTDPSASKACGPTGAQPRCCGSGPTPIQPR

SEQ ID NO: 7207 - protein, 48 aa, Canis lupus familiaris
PDFWKARSQQQRLHEHASHQQHEHRRGSDRGPAQEVSRDREPCQVCTL

SEQ ID NO: 7208 - protein, 10 aa, Canis lupus familiaris
PDPLSPPRRR

SEQ ID NO: 7209 - protein, 68 aa, Canis lupus familiaris
PDPRLWVPQGHLLRLPRSPQRLDWTRRERAEPGGLPVSPPSLHPPWRLLQGDPREPPEPPPEASQWPL

SEQ ID NO: 7210 - protein, 30 aa, Canis lupus familiaris
PDRGLQGREPGGARGPGQRPPGPRHEEAAL

SEQ ID NO: 7211 - protein, 57 aa, Canis lupus familiaris
PDRPAAPAPAPAQEDAVQDPLPAHAQGPQHQPCPGSGWAASEAFPGVPQCGREPGGQ

SEQ ID NO: 7212 - protein, 49 aa, Canis lupus familiaris
PDTKPTNAVGFATTPWQSTSHPQSTRSSRPWSTSRIPKRLPRSAVCPPS

SEQ ID NO: 7213 - protein, 27 aa, Canis lupus familiaris
PEAAPGLPAGSAGPSPPHPPAAPGLPP

SEQ ID NO: 7214 - protein, 19 aa, Canis lupus familiaris
PEAQADQGQYFHGEVACSR

SEQ ID NO: 7215 - protein, 56 aa, Canis lupus familiaris
PEAWAPLNRLGRQGQPWGHSSSNQLEPPSLGQSHQGFPPLDPMAPHRSPTNKLLPQ

SEQ ID NO: 7216 - protein, 8 aa, Canis lupus familiaris
PEESQSAE

SEQ ID NO: 7217 - protein, 16 aa, Canis lupus familiaris
PEPASELLEEQLQDLL

SEQ ID NO: 7218 - protein, 75 aa, Canis lupus familiaris
PEPCAPRGAEPRALSGHRDPPDPVQRVQVRAGARGHLPGRGRGVLGEPARAAGGGAPPLRGACGGAARGRVGHRV

SEQ ID NO: 7219 - protein, 39 aa, Canis lupus familiaris
PEPQGAPHQWLALLPLHGNWGLCGCSHCGSCCLVVHVCR

SEQ ID NO: 7220 - protein, 21 aa, Canis lupus familiaris
PEQRPPAQQPSVRNRLRGGTG

SEQ ID NO: 7221 - protein, 67 aa, Canis lupus familiaris
PERAATRGSRRRPGPRPARAAAAPWTRGHGRRPVRFHLRQHAALREPRPGDATAAPGGAAGPGAPAP

SEQ ID NO: 7222 - protein, 56 aa, Canis lupus familiaris
PERIYHQVGRGAAGEGAAEDGAAQRLLTQTSRHDFANDSSQTHTSSPGWQEVRAQT

SEQ ID NO: 7223 - protein, 16 aa, Canis lupus familiaris
PESDDTLQKQPQRGPI

SEQ ID NO: 7224 - protein, 10 aa, Canis lupus familiaris
PFPAPLDSIP

SEQ ID NO: 7225 - protein, 19 aa, Canis lupus familiaris
PFPPFPPLCRSPPGPPRRR

SEQ ID NO: 7226 - protein, 83 aa, Canis lupus familiaris
PFQPGPVPEPCPGAYHRRADAVQPLPWPLPRAAAAAPASGPWPPSPSTAATAPTTAPSPAGRGHPGTPPVLLPDLRAVRGSIP

SEQ ID NO: 7227 - protein, 59 aa, Canis lupus familiaris
PFSLLCSTSTCLAPPTIVFSHTSSGITSPWGSTRDTSSVSHSSSSTSLQFSKFTGSRET

SEQ ID NO: 7228 - protein, 27 aa, Canis lupus familiaris
PFWGSSWPTTTILRMRNSDQRCSKERK

SEQ ID NO: 7229 - protein, 92 aa, Canis lupus familiaris
PGAAPGGAPWRCPLEPWSLQERAGSRNLPRRGGPARPGKGPEPSKARILARAPAAAPSRIWQRKWVEGPVRSLQWEGPSTASPQVSHFGGPF

SEQ ID NO: 7230 - protein, 22 aa, Canis lupus familiaris
PGAGGRRWPVPASRARVEERAL

SEQ ID NO: 7231 - protein, 36 aa, Canis lupus familiaris
PGAPPTTQTGSAPTTCPWGQRPPAPSVAPGCRAGAA

SEQ ID NO: 7232 - protein, 49 aa, Canis lupus familiaris
PGAPRSPSSVAGSSSATWQLGAMWVQPLWELLPGGSCMQMTGLVSPTAS

SEQ ID NO: 7233 - skipped

SEQ ID NO: 7234 - protein, 9 aa, Canis lupus familiaris
PGARGPHVL

SEQ ID NO: 7235 - protein, 85 aa, Canis lupus familiaris
PGARPSHLLHSKHSKRLQEQPGPQFLRRICHPRAPGIQHLQPRVWARTPQGRGRLQRGPEPASPAPFQLPFGQRLHPEAQLGLRL

SEQ ID NO: 7236 - protein, 33 aa, Canis lupus familiaris
PGEAALPDPYPRPRAWALSCRIEIRSPHPTSGA

SEQ ID NO: 7237 - protein, 8 aa, Canis lupus familiaris
PGEGHHHQ

SEQ ID NO: 7238 - protein, 52 aa, Canis lupus familiaris
PGEQGPQAPEETTATSPGPEEPVHHPGTRISNQDLHCTVQSNQISLSRKKRY

SEQ ID NO: 7239 - skipped

SEQ ID NO: 7240 - protein, 48 aa, Canis lupus familiaris
PGGAPGHPRPGTRRPGPVLYGADNCADCQPGAGLLRDFSNSSDWKQDG

SEQ ID NO: 7241 - protein, 88 aa, Canis lupus familiaris
PGGAPRGPRAQGGGGQEGGSARRREGAGGPHGATPQGRGAPPAPGGGAPPGRGLLPRPFPAPLHLYLRGHRLLDHLLHLHLHPPAAGL

SEQ ID NO: 7242 - protein, 87 aa, Canis lupus familiaris
PGGEARPSARSWQLPESPTRPAQTPPPQPCHAKPHRGHPGPGAVHHPRPSRPCLHHPYAVLAPAHDELEIPEPSLAPACQIPHQTRL

SEQ ID NO: 7243 - protein, 21 aa, Canis lupus familiaris
PGGGAAGGGEPPSRAAASRAY

SEQ ID NO: 7244 - protein, 12 aa, Canis lupus familiaris
PGGKDRLLFTVP

SEQ ID NO: 7245 - protein, 17 aa, Canis lupus familiaris
PGGLQQHGGSRAAGRAG

SEQ ID NO: 7246 - protein, 26 aa, Canis lupus familiaris
PGHREGGAGQDGSQPLCLCPGSRRSL

SEQ ID NO: 7247 - protein, 62 aa, Canis lupus familiaris
PGIARASRLTRSAGAAPGLFGASTPGWHARAPWTSGTAEPGKRATSISRANTIPAAENSSAR

SEQ ID NO: 7248 - protein, 33 aa, Canis lupus familiaris
PGKNLSSSRKGSCRRGSGRGWSSSEAPHPNLQA

SEQ ID NO: 7249 - protein, 18 aa, Canis lupus familiaris
PGLFWEPLVPPALRSPTP

SEQ ID NO: 7250 - protein, 11 aa, Canis lupus familiaris
PGNCPRCLLHR

SEQ ID NO: 7251 - protein, 17 aa, Canis lupus familiaris
PGNSQREATAADQSDPL

SEQ ID NO: 7252 - protein, 8 aa, Canis lupus familiaris
PGPAATTV

SEQ ID NO: 7253 - protein, 15 aa, Canis lupus familiaris
PGPAATTVLQPHPPI

SEQ ID NO: 7254 - skipped

SEQ ID NO: 7255 - protein, 13 aa, Canis lupus familiaris
PGPGQRPHRPPGQ

SEQ ID NO: 7256 - protein, 62 aa, Canis lupus familiaris
PGPPSPGRRHQRPRELEAGKAGPRAAGKGRDEGSGGPRVGGPRPGTSGQGALRRAWAAQPSR

SEQ ID NO: 7257 - protein, 18 aa, Canis lupus familiaris
PGPTQRGAGPPQYRGLRL

SEQ ID NO: 7258 - protein, 28 aa, Canis lupus familiaris
PGQPSRPQPCSSRPPPRPPRLTDSSRRR

SEQ ID NO: 7259 - protein, 95 aa, Canis lupus familiaris
PGRPPGTGTGRGARAAAGWGWSCPFAGRRAPALSSTAAAPARREGTEGTEGTGRCSLCASRRPPRRPCTASTTTPTRIHPWPWHPRGDRPPSPGP

SEQ ID NO: 7260 - protein, 47 aa, Canis lupus familiaris
PGRVRVPVARGRPPPRAPRGEAFESGRQEQTARRVHHVPRGGDGPRV

SEQ ID NO: 7261 - protein, 9 aa, Canis lupus familiaris
PGSDSGLGG

SEQ ID NO: 7262 - protein, 65 aa, Canis lupus familiaris
PGSGPWHRTCCSGYFARTPRSDWVQGPRGHRKSRTTPSSRVWIGPLWLPGKFQPHSDHRSARSWM

SEQ ID NO: 7263 - protein, 12 aa, Canis lupus familiaris
PGSPQPVPLPAA

SEQ ID NO: 7264 - protein, 10 aa, Canis lupus familiaris
PGSQTAYFSE

SEQ ID NO: 7265 - protein, 16 aa, Canis lupus familiaris
PGWAASQRLTWVCHHR

SEQ ID NO: 7266 - protein, 10 aa, Canis lupus familiaris
PGWIRAPPPV

SEQ ID NO: 7267 - protein, 73 aa, Canis lupus familiaris
PGWSAWWTTGARPWLRAPWRPPALCAASWGRWWSWPAATVPCCAGPPRTAGPWAWPSCWAFLSAGPPTNCWGW

SEQ ID NO: 7268 - protein, 33 aa, Canis lupus familiaris
PHAGVCTEEIAILMRMTSPNASVPVATWENIVK

SEQ ID NO: 7269 - protein, 11 aa, Canis lupus familiaris
PHCWATWTRSG

SEQ ID NO: 7270 - protein, 18 aa, Canis lupus familiaris
PHEELCDQGVGWGVCGGR

SEQ ID NO: 7271 - skipped

SEQ ID NO: 7272 - protein, 39 aa, Canis lupus familiaris
PHHPRHQTSVLSFTTANTVPTVIGQLWECLSTTRKDTQR

SEQ ID NO: 7273 - protein, 41 aa, Canis lupus familiaris
PHHPTTPPCSPLAPPCPHPHPCCRCQGTLGPQMLTPFLSRT

SEQ ID NO: 7274 - protein, 54 aa, Canis lupus familiaris
PHLCHPHPHPPRSQPSLHKRGQGGKLIPPAKTLPKVPVVARATTKTLPLPSTEK

SEQ ID NO: 7275 - skipped

SEQ ID NO: 7276 - protein, 38 aa, Canis lupus familiaris
PHLCPGRGDHAGARELLSHLPPSDSGRPAFPGAAYHGD

SEQ ID NO: 7277 - protein, 28 aa, Canis lupus familiaris
PHLHPQPPAPALGWAPTPTMSSGAPGLL

SEQ ID NO: 7278 - protein, 23 aa, Canis lupus familiaris
PHLHSPGGLRPHLPLRDYPQPLT

SEQ ID NO: 7279 - protein, 45 aa, Canis lupus familiaris
PHLPLLPSRLSSSPTLSRCSPLGEAPSLLPLPLQLGPLQPSLPRS

SEQ ID NO: 7280 - protein, 39 aa, Canis lupus familiaris
PHLSPFPLHHHAPCLQTPEWPRAWPPGWKPAPVLQQYPH

SEQ ID NO: 7281 - protein, 25 aa, Canis lupus familiaris
PHLSSALLWLPPATVPAPAHSLHPP

SEQ ID NO: 7282 - protein, 58 aa, Canis lupus familiaris
PHLTTKGEGWAHQWGVTVGAQVATAPSMGTPHPLPHHPSMAPTPTALCSWSMAWINLR

SEQ ID NO: 7283 - protein, 68 aa, Canis lupus familiaris
PHPCPPGNQSLLLAILPQAILSASLCCSSRDIFSSPHHRCQPVTVLQATITPVNLSIAQSLLSITIHI

SEQ ID NO: 7284 - protein, 10 aa, Canis lupus familiaris
PHPEEQLGMP

SEQ ID NO: 7285 - protein, 41 aa, Canis lupus familiaris
PHPEIRAAIHSPGRLAGRLREPLGSRRTSATLPQSGKNASK

SEQ ID NO: 7286 - protein, 19 aa, Canis lupus familiaris
PHPGCRSLRTASSETPQTT

SEQ ID NO: 7287 - protein, 29 aa, Canis lupus familiaris
PHPGPPKVRVSVGRRNKATRRKAASLLNS

SEQ ID NO: 7288 - protein, 21 aa, Canis lupus familiaris
PHPGPQPAALRKQHRRHRGPA

SEQ ID NO: 7289 - protein, 11 aa, Canis lupus familiaris
PHPHPPPLPPN

SEQ ID NO: 7290 - protein, 17 aa, Canis lupus familiaris
PHPLRPPWRARAPVPRT

SEQ ID NO: 7291 - skipped

SEQ ID NO: 7292 - protein, 66 aa, Canis lupus familiaris
PHPNTGPPNPDSPEPPPPPHPPPLLPPGPSIPAPLLPCRTPTPRGCSWGLRQGARRMRGWRPSRRF

SEQ ID NO: 7293 - protein, 20 aa, Canis lupus familiaris
PHPPHYLHRQRHLKQCKTVQ

SEQ ID NO: 7294 - protein, 66 aa, Canis lupus familiaris
PHPPPPPTPRGRRRGRRCWRSWRQRRSSRSRCSTSPRASAATRCRAPCTPSLACSCPPAPCSALRN

SEQ ID NO: 7295 - protein, 30 aa, Canis lupus familiaris
PHPRPLPWETFLCSGCGFVHPASRQATCLL

SEQ ID NO: 7296 - protein, 12 aa, Canis lupus familiaris
PHPRQAWGPARE

SEQ ID NO: 7297 - protein, 65 aa, Canis lupus familiaris
PHQQCPWYLVLLAPMLCPPLAMCLGYLLQPQSHLIAPAVPMGPWDGVQGCNTLHSGLLCHHLLCL

SEQ ID NO: 7298 - protein, 60 aa, Canis lupus familiaris
PHRESRLRTSPGGPWLRMCWWERKQVIARHPRNMLFGPVCVASMPFCSCVSTSSSTPTLP

SEQ ID NO: 7299 - protein, 53 aa, Canis lupus familiaris
PHRGPLLPPHPGVPSCLPRPHTHEGHGGQGRHTTSSVPSPRSPLWSHSHHTQG

SEQ ID NO: 7300 - protein, 58 aa, Canis lupus familiaris
PHRGPPLCPATCQPPVPPALHAPRAPSQPQVPCTSQPPIVLLRQEEPPSPPPPLALLP

SEQ ID NO: 7301 - protein, 25 aa, Canis lupus familiaris
PHRGSTWPLTTAPCLLVWLCLALLG

SEQ ID NO: 7302 - protein, 10 aa, Canis lupus familiaris
PHRLLGPSRW

SEQ ID NO: 7303 - protein, 80 aa, Canis lupus familiaris
PHRYPPCHRRGPAASGTLGLRPSTLTCPAAGRTWSLRRKPSQWCPCGGNGLVGETAGATGLVDPRGWSATWPGMRAPQPL

SEQ ID NO: 7304 - skipped

SEQ ID NO: 7305 - protein, 84 aa, Canis lupus familiaris
PHRYPPCHRRGPAASGTLGLRPSTLTCPAAGRTWSLRRKPSQWCPCGGNGLVGETAVSTQGATGLVDPRGWSATWPGMRAPQPL

SEQ ID NO: 7306 - protein, 84 aa, Canis lupus familiaris
PHRYPPCHRRGPAASGTLGLRPSTLTCPAAGRTWSLRRKPSQWCPCGGNGLVGETAVSTVGATGLVDPRGWSATWPGMRAPQPL

SEQ ID NO: 7307 - protein, 85 aa, Canis lupus familiaris
PHRYPPCHRRGPAASGTLGLRPSTLTCPAAGRTWSLRRKPSQWCPCGGNGLVGETAVSTVQGATGLVDPRGWSATWPGMRAPQPL

SEQ ID NO: 7308 - protein, 30 aa, Canis lupus familiaris
PHSAPAWPRGPPQPPQRRAAWPPSPPRGTA

SEQ ID NO: 7309 - protein, 27 aa, Canis lupus familiaris
PHSASRGPDLCRILNSRNMPPRSFGIC

SEQ ID NO: 7310 - protein, 12 aa, Canis lupus familiaris
PHSPSPLWPPSD

SEQ ID NO: 7311 - protein, 31 aa, Canis lupus familiaris
PHTAQQPGPTWGPWAPEFSTTTATPFQPAAR

SEQ ID NO: 7312 - protein, 47 aa, Canis lupus familiaris
PHTPRGGGDRGGGVWRRGLTLPTGPTAPTRGGRATPKGSLNLRAGTR

SEQ ID NO: 7313 - protein, 17 aa, Canis lupus familiaris
PHYLHRQRHLKQCKTVQ

SEQ ID NO: 7314 - protein, 12 aa, Canis lupus familiaris
PITNSVSFPARA

SEQ ID NO: 7315 - protein, 13 aa, Canis lupus familiaris
PITVCLCTTQTMG

SEQ ID NO: 7316 - protein, 44 aa, Canis lupus familiaris
PKARCPRVGCLHSQLPHPHPIPTSDTPKFNLIPPSSSPSTPRGT

SEQ ID NO: 7317 - protein, 50 aa, Canis lupus familiaris
PKARCPRVGCLHSQLPHPHPIPTSDTPKVSSLARRLDFQEEPMTGFVSSR

SEQ ID NO: 7318 - skipped

SEQ ID NO: 7319 - protein, 77 aa, Canis lupus familiaris
PKARCPRVGCLHSQLPHPHPIPTSDTPKYVGWAEATVAAARGLLLALSFASLRPRSVVIQQPPSPLPPQLSVTPTVS

SEQ ID NO: 7320 - protein, 13 aa, Canis lupus familiaris
PKERRAESLWFSL

SEQ ID NO: 7321 - protein, 17 aa, Canis lupus familiaris
PKKCCYRRKINMKLIRV

SEQ ID NO: 7322 - protein, 64 aa, Canis lupus familiaris
PKKTRSRGRGELRRGAGGVPGPAAAAHRVAEGTEPAKGLVRPQRPGLADTHAGQAAPPWARPER

SEQ ID NO: 7323 - protein, 52 aa, Canis lupus familiaris
PKPCPLLAAPAPRRTRMAWSLRWPLQAPQPLSLLCLLSCMCPAHSSHLSNSC

SEQ ID NO: 7324 - protein, 56 aa, Canis lupus familiaris
PKPQHFSMWKRHHHKGLCVQARACFPLTEHQGLAWPHDLTFSCKKQHRDLSASMHF

SEQ ID NO: 7325 - protein, 56 aa, Canis lupus familiaris
PKPQHFSVWKRHHHKGLCVQARACFPLTEHQGLAWPHDLTFSCKKQHRDLSASMHF

SEQ ID NO: 7326 - protein, 12 aa, Canis lupus familiaris
PKPVPASGGVPG

SEQ ID NO: 7327 - protein, 26 aa, Canis lupus familiaris
PKPVSLGLGPHLCRSSQARWGTGQPS

SEQ ID NO: 7328 - protein, 88 aa, Canis lupus familiaris
PKRPARPIQAFIFPPYPHWLAFPRHHCPQLHPASCLSAPLALPSLAAVRHLWSPWQRLSRSCRCCRNNWEKVSAPSILLPQLHCQATI

SEQ ID NO: 7329 - protein, 26 aa, Canis lupus familiaris
PKRPARPIQVSAPSILLPQLHCQATI

SEQ ID NO: 7330 - protein, 15 aa, Canis lupus familiaris
PKTCWAPLRPSQGKT

SEQ ID NO: 7331 - protein, 12 aa, Canis lupus familiaris
PLAAASAARPGP

SEQ ID NO: 7332 - protein, 10 aa, Canis lupus familiaris
PLACTLSRAS

SEQ ID NO: 7333 - protein, 18 aa, Canis lupus familiaris
PLDPMAPHRSPTNKLLPQ

SEQ ID NO: 7334 - protein, 34 aa, Canis lupus familiaris
PLFQYYLSNLCPLRMLETVYAFAVFPMRPPLKTS

SEQ ID NO: 7335 - protein, 42 aa, Canis lupus familiaris
PLFRHSCLSPPVVGWVWSSSGVGFWDGSLKERERTDAPRQVR

SEQ ID NO: 7336 - protein, 13 aa, Canis lupus familiaris
PLGAPNPPHPWPQ

SEQ ID NO: 7337 - skipped

SEQ ID NO: 7338 - protein, 22 aa, Canis lupus familiaris
PLGFASSSEIPAAAAAPPRASL

SEQ ID NO: 7339 - protein, 10 aa, Canis lupus familiaris
PLGPGPSWLR

SEQ ID NO: 7340 - protein, 97 aa, Canis lupus familiaris
PLGRCPAGPRCPGWPRWTSPSWSGTSAPTGSWYPATRRPWSWVPAPVPTSVAASAAVAPSAAIRCPLPGPVGPACLSAAAACLWELGAGPHQGSSGA

SEQ ID NO: 7341 - protein, 27 aa, Canis lupus familiaris
PLHPLSHQQCSPQGPLLSETWALCPQN

SEQ ID NO: 7342 - protein, 44 aa, Canis lupus familiaris
PLHPPHAWPQGAWSSTGPADLCPQVALGCQEAPGRSRDREATAP

SEQ ID NO: 7343 - protein, 29 aa, Canis lupus familiaris
PLHSQRPRLVSHPHPSCHRCHPSPQGCFP

SEQ ID NO: 7344 - protein, 15 aa, Canis lupus familiaris
PLHTPRQSERGAPVL

SEQ ID NO: 7345 - protein, 68 aa, Canis lupus familiaris
PLKQLPQRRNQDRRSLKMEAMTRIKRWKLLWHLQKSKNHYPSSKRLNKKVDQERRKFLQRSKRQKMYW

SEQ ID NO: 7346 - protein, 15 aa, Canis lupus familiaris
PLLGDGLPGLAGAEA

SEQ ID NO: 7347 - protein, 14 aa, Canis lupus familiaris
PLLGPSPRWAGQKV

SEQ ID NO: 7348 - protein, 32 aa, Canis lupus familiaris
PLLHVDPVPMGGSVGSRGVWQVMVPCSLRRRD

SEQ ID NO: 7349 - skipped

SEQ ID NO: 7350 - protein, 15 aa, Canis lupus familiaris
PLLSRSWMCPSHLLT

SEQ ID NO: 7351 - protein, 38 aa, Canis lupus familiaris
PLMASRARQPKMAQQVHLPYHRPPQGPASLGRGSVASP

SEQ ID NO: 7352 - skipped

SEQ ID NO: 7353 - protein, 45 aa, Canis lupus familiaris
PLPHPLPSQALQLRRCRLLLYLPLLLLLHPRCLGRPHPQWFSTQD

SEQ ID NO: 7354 - protein, 18 aa, Canis lupus familiaris
PLPPGPAQDTTLHLSAQC

SEQ ID NO: 7355 - protein, 57 aa, Canis lupus familiaris
PLPPGTGPCTTGSGCRRPGAAAPTATSSATCPWCGAAGVSGLTTRERRNCGAWRLPW

SEQ ID NO: 7356 - protein, 10 aa, Canis lupus familiaris
PLPPPRAAPV

SEQ ID NO: 7357 - protein, 67 aa, Canis lupus familiaris
PLPQPLSPQRQTSLSRRWSSLALGPSCASPPPPPARPGPGPRPLETISLPTFRGLGPQQAPTSGCPH

SEQ ID NO: 7358 - protein, 10 aa, Canis lupus familiaris
PLPSRIIRIP

SEQ ID NO: 7359 - protein, 25 aa, Canis lupus familiaris
PLPVLLLGPLGQDSSSSHPPHHSPR

SEQ ID NO: 7360 - protein, 41 aa, Canis lupus familiaris
PLQPMKSPPPQLGHPWGACAPALLASWGPPPQCRSRRSICH

SEQ ID NO: 7361 - protein, 12 aa, Canis lupus familiaris
PLQTLCRSPLGL

SEQ ID NO: 7362 - protein, 12 aa, Canis lupus familiaris
PLRGHAQMCRVS

SEQ ID NO: 7363 - protein, 16 aa, Canis lupus familiaris
PLRGSAFLKSRKGPGK

SEQ ID NO: 7364 - protein, 66 aa, Canis lupus familiaris
PLRLCCLQPPTSPSTTTACTLEPQVPSESLRRDQHHTPCPISRPAEIRTACPSQLGWGSCPPLPCT

SEQ ID NO: 7365 - protein, 34 aa, Canis lupus familiaris
PLRMRPCCTVSWKESSTTVRQSCSSCGTVWTRVR

SEQ ID NO: 7366 - protein, 23 aa, Canis lupus familiaris
PLRSPWRGSGRCTIPATTMTSPP

SEQ ID NO: 7367 - protein, 11 aa, Canis lupus familiaris
PLRSTGPPGAH

SEQ ID NO: 7368 - skipped

SEQ ID NO: 7369 - protein, 8 aa, Canis lupus familiaris
PLSAWPRP

SEQ ID NO: 7370 - protein, 45 aa, Canis lupus familiaris
PLSCFLINRKLVTEVVIYRAMQRCGEDPLPLPPRETRIPSSQETG

SEQ ID NO: 7371 - skipped

SEQ ID NO: 7372 - protein, 40 aa, Canis lupus familiaris
PLSVSSGTGGHGHPARPSPSAASAGGSRETTCHSARTGER

SEQ ID NO: 7373 - protein, 26 aa, Canis lupus familiaris
PLTIGYLLVLKICHFCPGAWVTLNSW

SEQ ID NO: 7374 - protein, 21 aa, Canis lupus familiaris
PLTRRRTPRPRGSGGLRRTWP

SEQ ID NO: 7375 - protein, 62 aa, Canis lupus familiaris
PLTSTPSSSLVHTKQPSWDPRTCFLTTNVKISTGNPTRGKASMRDCGRSRTIPTPATVLLCR

SEQ ID NO: 7376 - protein, 41 aa, Canis lupus familiaris
PLVPSLSGHRQPAGPVCPGPHAWSSCRGRLPGGRRPGGGGC

SEQ ID NO: 7377 - protein, 34 aa, Canis lupus familiaris
PMGVAGRRAGWLARTATAATCSFRARVRPWSCPR

SEQ ID NO: 7378 - protein, 40 aa, Canis lupus familiaris
PMPIFCTAYWRGLAAAPLKSLRLTLALGSSEPVAPWIGKK

SEQ ID NO: 7379 - protein, 12 aa, Canis lupus familiaris
PMQVYVRRKLLF

SEQ ID NO: 7380 - protein, 12 aa, Canis lupus familiaris
PMSCPPLCPSRC

SEQ ID NO: 7381 - protein, 49 aa, Canis lupus familiaris
PMWESQPGLHPGTEVYHQSGQQGTWTGTPASPCRTQSRTGPLVPSRSLC

SEQ ID NO: 7382 - protein, 65 aa, Canis lupus familiaris
PNHQSPEGHPNFPPERGTRGHDAHEYPRFRHTAWWSSECSHWPPRTPWSWPDPGLHPHPAALPAP

SEQ ID NO: 7383 - protein, 52 aa, Canis lupus familiaris
PNPAHYWQPQHPGEPEWLGACAGHFRPLSPFLYSVSSAACALPTAATSATVV

SEQ ID NO: 7384 - skipped

SEQ ID NO: 7385 - protein, 16 aa, Canis lupus familiaris
PPAPAPPELPAGHARP

SEQ ID NO: 7386 - protein, 20 aa, Canis lupus familiaris
PPARLLQPSPWTRGDRPALV

SEQ ID NO: 7387 - protein, 48 aa, Canis lupus familiaris
PPASRPWTGCSPTAAPSTAPRSTLTSWSATGRVSPPGTGSTGSLPVGK

SEQ ID NO: 7388 - protein, 72 aa, Canis lupus familiaris
PPCGPASGQGEPLPLPAALRHLRRICRRRRPVVHAKRHQLPSAPDTLPLQRRQSRPSTEEPAQPHCTVTRGS

SEQ ID NO: 7389 - protein, 65 aa, Canis lupus familiaris
PPCSSHRLGGSRFQRLYRLKPRWPSLPASCQDQRSLGASNERPVQASPLRMLPLWPHPSALITLV

SEQ ID NO: 7390 - protein, 37 aa, Canis lupus familiaris
PPDLHARHFLQLVWSGVTILDLPHGGDLPQPQRAPPP

SEQ ID NO: 7391 - protein, 58 aa, Canis lupus familiaris
PPGLHQDNPGPRPAWPPQVRARPQKDQGGEPRGAACPRSPLPHPGLRRDCQGGQDIQV

SEQ ID NO: 7392 - protein, 35 aa, Canis lupus familiaris
PPGPTPSARLVPRAGQHEQRHRGRPRVGPVGACVC

SEQ ID NO: 7393 - protein, 24 aa, Canis lupus familiaris
PPGTRRGHSVGALRVPHPCSWRPL

SEQ ID NO: 7394 - protein, 28 aa, Canis lupus familiaris
PPLPCPGPHPTAAATGAGRSFVATPWDM

SEQ ID NO: 7395 - protein, 23 aa, Canis lupus familiaris
PPLPSFASLDYAGAEATPVGRRR

SEQ ID NO: 7396 - protein, 41 aa, Canis lupus familiaris
PPPFTGSFLQWCARAGSSQLPRSRNQLCTLFPTPRSAMSHW

SEQ ID NO: 7397 - protein, 59 aa, Canis lupus familiaris
PPPGLRAGGPELWAPPGPPAGSAGAAGRGWGAPTRSRCSPGIHFGSRGACSRRMSPAAR

SEQ ID NO: 7398 - protein, 50 aa, Canis lupus familiaris
PPPGPLGPQFPRRLAWQTRSWWWWCSGPQVLREAPWPGRSWKMGRLEFEW

SEQ ID NO: 7399 - protein, 8 aa, Canis lupus familiaris
PPPGPRPA

SEQ ID NO: 7400 - skipped

SEQ ID NO: 7401 - protein, 100 aa, Canis lupus familiaris
PPPGWAQHLHPPPAGPGAAVGRQGGGGRRCPGAQVHRRRLPAGHRHRGCGAGRGGGPLGASRPTRAAPPPSKAVGASFQGRGSRTSGVLVRSAQPAAAGP

SEQ ID NO: 7402 - protein, 29 aa, Canis lupus familiaris
PPPPPAAPAAARPFGREEEPPLEKLQVDD

SEQ ID NO: 7403 - protein, 38 aa, Canis lupus familiaris
PPPPPPPPPRRIARGGRRAATRGASRRGGLRWNPGARR

SEQ ID NO: 7404 - protein, 48 aa, Canis lupus familiaris
PPPPPSAPPTPSPAPRAAAQGAAARAASHRRRLPAGTRRSSQRRFWEQ

SEQ ID NO: 7405 - skipped

SEQ ID NO: 7406 - protein, 98 aa, Canis lupus familiaris
PPPPTRPRMQRPPSRSPRLPSLPALTSCLPTPPPQTARRRRRQRRPWYMVPCPSHCWGRTRCCSAGPGPVGPGGPAPTSLERHSAAASVGGASGGVRL

SEQ ID NO: 7407 - protein, 70 aa, Canis lupus familiaris
PPPPWSRSPSWASRRPRCWRTCCGSSSGRCPSWLPSAGSSGCRRAATRPPRTCSWCSRSGAGPTPRSASR

SEQ ID NO: 7408 - protein, 29 aa, Canis lupus familiaris
PPPRPGPARGTGSHDGGGLDGPCAGICDL

SEQ ID NO: 7409 - skipped

SEQ ID NO: 7410 - protein, 44 aa, Canis lupus familiaris
PPPSSGCAQPPTAAARARPLGPRRPLSSRPGAGPGAGGRARSYK

SEQ ID NO: 7411 - protein, 53 aa, Canis lupus familiaris
PPPTPRLFPRPTSPPAAAGAPGHQAARDRRGEAVPGRGVLRGSSSCQLCSRVT

SEQ ID NO: 7412 - protein, 19 aa, Canis lupus familiaris
PPPWLSATTWAPTSTCSRP

SEQ ID NO: 7413 - protein, 22 aa, Canis lupus familiaris
PPPWRPQRRHPGSWLPVPGCFL

SEQ ID NO: 7414 - protein, 23 aa, Canis lupus familiaris
PPQPGNQRPNRSLPGTTRMRHRV

SEQ ID NO: 7415 - protein, 14 aa, Canis lupus familiaris
PPQPQTKEAAAPTP

SEQ ID NO: 7416 - protein, 34 aa, Canis lupus familiaris
PPRPLNTDLRRPPPLRAHLGWRSKLAARPPARRE

SEQ ID NO: 7417 - protein, 55 aa, Canis lupus familiaris
PPRPPPPRPSLPTLPLPTPPLPPPPPFHTQPQRTGLTPKADLCGSRETIPRQRIL

SEQ ID NO: 7418 - protein, 33 aa, Canis lupus familiaris
PPRPRSCTAWALGAPQPPPRRGAERASPGRPGV

SEQ ID NO: 7419 - protein, 59 aa, Canis lupus familiaris
PPSLPWLLPLPCCRKNLSSLPDSPSLPSHLPQECPHCLLPLPSHRPHSLAQALPLPPSP

SEQ ID NO: 7420 - protein, 81 aa, Canis lupus familiaris
PPSSPPAPCSTSSSPPTTPGRGQASLCATRSSRQALKTVQKTSQAPMGPSNPLGFLRSTHTTWIAPLPSWPNPRWRSSCSS

SEQ ID NO: 7421 - protein, 42 aa, Canis lupus familiaris
PPTTASPGPPAITRRCGRPTTAAARTSPTCPRPQTGTASLSC

SEQ ID NO: 7422 - protein, 84 aa, Canis lupus familiaris
PPVPSRRGCGGEARGGAELRAGRAAGAAPSLAARTRAAASAGTSSGFRASRPDLSRFSATWQPARPPPRGKSMEQSVATSPWSV

SEQ ID NO: 7423 - protein, 21 aa, Canis lupus familiaris
PPVVPPAPPRGPRPWFRPTAL

SEQ ID NO: 7424 - protein, 41 aa, Canis lupus familiaris
PQATALLHVETPPPQRSVCPSSCVFPSYRAPGPCLATRPHF

SEQ ID NO: 7425 - protein, 41 aa, Canis lupus familiaris
PQATALLRVETPPPQRSVCPSSCVFPSYRAPGPCLATRPHF

SEQ ID NO: 7426 - protein, 40 aa, Canis lupus familiaris
PQDPQACPLGCQVSPPEGLPSLGLKDPWRMLLPPRAHLRS

SEQ ID NO: 7427 - protein, 8 aa, Canis lupus familiaris
PQEEVDGD

SEQ ID NO: 7428 - protein, 23 aa, Canis lupus familiaris
PQERPWPSHWSSGCVCWWLGLKV

SEQ ID NO: 7429 - protein, 9 aa, Canis lupus familiaris
PQFPRYHFL

SEQ ID NO: 7430 - protein, 25 aa, Canis lupus familiaris
PQHLLASPRRPRRGQWAPRRARTPP

SEQ ID NO: 7431 - protein, 15 aa, Canis lupus familiaris
PQKRKTSAVGSNTSS

SEQ ID NO: 7432 - protein, 61 aa, Canis lupus familiaris
PQLPMRRQLPLVLGRPRPWLPLLPLSSLQPRGLPRQGQLPPQPPVTRGSSEFPTRAWNPWS

SEQ ID NO: 7433 - protein, 14 aa, Canis lupus familiaris
PQNPLLPPLLPLLL

SEQ ID NO: 7434 - protein, 44 aa, Canis lupus familiaris
PQPGRAAQAAHRRAAPQVPGRLAAAAQLPVRARQGRPQAALRLV

SEQ ID NO: 7435 - protein, 28 aa, Canis lupus familiaris
PQPPARPRPRCPGGGPRPPGCPWSSWSR

SEQ ID NO: 7436 - protein, 21 aa, Canis lupus familiaris
PQPPVTRGSSEFPTRAWNPWS

SEQ ID NO: 7437 - protein, 30 aa, Canis lupus familiaris
PQPRGWWEGLRHTLRRQGGRLMRDWARAAE

SEQ ID NO: 7438 - protein, 16 aa, Canis lupus familiaris
PQPRPACPGRPGTPSS

SEQ ID NO: 7439 - protein, 64 aa, Canis lupus familiaris
PQPSTTPAWASTSTSHPGHTPAACPSRRLHLPSPHSPRASRASSLHPCTPGRLCYLPRRCSRAP

SEQ ID NO: 7440 - protein, 65 aa, Canis lupus familiaris
PQPTEAACVPGPCSNTRCATARSVRGPTRTSGPSNVPSATPTTSTRMPSTAGSPMSLKMMPRSVS

SEQ ID NO: 7441 - protein, 42 aa, Canis lupus familiaris
PQPTPPSAPRCSRTARALLRSIGVEAKGELGWQQRFRAVGGE

SEQ ID NO: 7442 - protein, 10 aa, Canis lupus familiaris
PQQTTQQDSR

SEQ ID NO: 7443 - protein, 32 aa, Canis lupus familiaris
PQQVPGAAAPAAAAQMRTGPSWMGAWSLMGPV

SEQ ID NO: 7444 - protein, 40 aa, Canis lupus familiaris
PQRPHQSHRIRYLTHSPQLSHLTGLLPPSLHPKARVFELP

SEQ ID NO: 7445 - protein, 40 aa, Canis lupus familiaris
PQRPPTSACCASLCPSGRCCCSSATGRCRSAAGATGLTWC

SEQ ID NO: 7446 - skipped

SEQ ID NO: 7447 - protein, 17 aa, Canis lupus familiaris
PQSHYLLVVVSRSQYLI

SEQ ID NO: 7448 - protein, 8 aa, Canis lupus familiaris
PQSPRNKP

SEQ ID NO: 7449 - protein, 32 aa, Canis lupus familiaris
PQTSPSFWRSSWITSKRIQPMISAMSLMSQVA

SEQ ID NO: 7450 - protein, 72 aa, Canis lupus familiaris
PQWPWSLPLPTPCPAEIGPRSSCLPASPCRAVRMESRQISQLCVLSGSVANLPSWPSALGKTSATHLPSWRS

SEQ ID NO: 7451 - protein, 67 aa, Canis lupus familiaris
PQWWGHTTLCSPELTAAPPPAPSMIPQKAGSQVRVPRTNWCTRCRRAHRRYQGRGGMVNVMSLKKFS

SEQ ID NO: 7452 - protein, 43 aa, Canis lupus familiaris
PRAAPGRESPRGCGLPEAAGLQWTGPLKSAREALGQAGGSTGS

SEQ ID NO: 7453 - protein, 60 aa, Canis lupus familiaris
PRAPPRAPTARPARPGSRTPRPARRPRAPRSRATCPSGARTRSPRARRRPEESPCPAWTT

SEQ ID NO: 7454 - protein, 16 aa, Canis lupus familiaris
PRARLRTARGATARSP

SEQ ID NO: 7455 - protein, 21 aa, Canis lupus familiaris
PRARTRRRRRRRTSPAWEPRS

SEQ ID NO: 7456 - protein, 42 aa, Canis lupus familiaris
PRASAPLRPWCSPSATCRVAPTSWCASASAAARAAGRAPRTT

SEQ ID NO: 7457 - protein, 9 aa, Canis lupus familiaris
PRAVRSPWG

SEQ ID NO: 7458 - skipped

SEQ ID NO: 7459 - protein, 46 aa, Canis lupus familiaris
PRCRHPGWSPRSWRPRPRSPPTTGTRTCSCSGASFWTTIWATRCLP

SEQ ID NO: 7460 - protein, 48 aa, Canis lupus familiaris
PRCSTFHRPLCKQSLWPHRCPAQVLRVRAHTHTASLSRPLLWRQLGRV

SEQ ID NO: 7461 - protein, 8 aa, Canis lupus familiaris
PREDTCGG

SEQ ID NO: 7462 - protein, 62 aa, Canis lupus familiaris
PRFLTNESPSTSSRRRASCVPEGRCQSPFLLVCPPSPKPSRLLPSPAGSPRGQLEACGGRVP

SEQ ID NO: 7463 - protein, 61 aa, Canis lupus familiaris
PRGAALAISMGARGMWASFKHSTLPLVVCLIISRITRGLSLQGVLSTNSRLPASSSSRYSS

SEQ ID NO: 7464 - protein, 14 aa, Canis lupus familiaris
PRGLVCRQRRLPRG

SEQ ID NO: 7465 - protein, 41 aa, Canis lupus familiaris
PRGPGPPQPQPQPLPPLGNGLFWRPTRRRTGRSESWSGASA

SEQ ID NO: 7466-7467 - skipped (2 entries)

SEQ ID NO: 7468 - protein, 19 aa, Canis lupus familiaris
PRGQPGPSRPSFSLHIHTG

SEQ ID NO: 7469 - protein, 46 aa, Canis lupus familiaris
PRGRARAPTPAGSGAPTRAGNPPSPPAPRFVSGGVALRRSRSHKSP

SEQ ID NO: 7470 - protein, 17 aa, Canis lupus familiaris
PRGRAWAPQKKGEGGRE

SEQ ID NO: 7471 - protein, 100 aa, Canis lupus familiaris
PRGRGRGRWGAPQPCRRLKSLLKKSPQLPQLCWKRGLRVGGTKCQSPRRRLRQKTWRPRWRQRRQPCRRRSRMTRLPCWLTSSIVPLMTTSHHRPQSLIP

SEQ ID NO: 7472 - protein, 46 aa, Canis lupus familiaris
PRHKRSRPCPRDGPVRSGCRACPWARQRSPPAPGLGAGGQAETPGL

SEQ ID NO: 7473 - protein, 11 aa, Canis lupus familiaris
PRHRGPPSLQF

SEQ ID NO: 7474 - protein, 17 aa, Canis lupus familiaris
PRIPSSPPSSPSSCRRW

SEQ ID NO: 7475 - protein, 53 aa, Canis lupus familiaris
PRKGHGPPTGPLDVSAGGWDSRCERWGHAAGQWGHRQRGPRGDLLQWPVGDRV

SEQ ID NO: 7476 - protein, 23 aa, Canis lupus familiaris
PRKGSCPRCTGTATSPSTPRRSL

SEQ ID NO: 7477 - protein, 47 aa, Canis lupus familiaris
PRKLPQMPPSSMTKHLSGCRARGTEGGRRSTLWRLKGMTSSVGPSSG

SEQ ID NO: 7478 - protein, 10 aa, Canis lupus familiaris
PRLDPSPSTR

SEQ ID NO: 7479 - protein, 14 aa, Canis lupus familiaris
PRLLESSLPAATAA

SEQ ID NO: 7480 - protein, 64 aa, Canis lupus familiaris
PRLRHRCPVSWRESETIRSMRECARRTAWSPGWELEQVLLLSEKWMRSHPRTISELTGRFSWAT

SEQ ID NO: 7481 - skipped

SEQ ID NO: 7482 - protein, 65 aa, Canis lupus familiaris
PRPAPPPWTAAAPWAAWPRPPLASRPGGGTCPGSPGPVGAPPSPQEVGGPGHFHASPRTGAPQAL

SEQ ID NO: 7483 - protein, 12 aa, Canis lupus familiaris
PRPAPTPLRKRR

SEQ ID NO: 7484 - protein, 20 aa, Canis lupus familiaris
PRPARRPPPRRSRRTPPPSL

SEQ ID NO: 7485 - protein, 8 aa, Canis lupus familiaris
PRPCCDHS

SEQ ID NO: 7486 - protein, 56 aa, Canis lupus familiaris
PRPCCDHSPAAPPAHLRWARSSTDCRRLRGASLQPPGLCRRPRCVRTVIIVWPPFP

SEQ ID NO: 7487 - protein, 94 aa, Canis lupus familiaris
PRPCPPVPPPRLLLLELPPWPPPLRRGPVPLPGWACPLPRRGAARAHLPARSAGRSSRSPATSTSTRSSTPARSPSPVPCAARASTAGRASSGT

SEQ ID NO: 7488 - protein, 26 aa, Canis lupus familiaris
PRPPALGPTGTLAPSAPLTSTSGLDT

SEQ ID NO: 7489 - protein, 96 aa, Canis lupus familiaris
PRPPGWSHLTRASSWASPAPRAPWDLLARASGLSALCGEPSRSPGSVLLCPAPAPPRALTVLQAVWPPPCSHALLLPRALTAFLCLLPSRAPGPCL

SEQ ID NO: 7490 - skipped

SEQ ID NO: 7491 - protein, 23 aa, Canis lupus familiaris
PRPPRLPASPDRTVAGAPRVPRP

SEQ ID NO: 7492 - protein, 57 aa, Canis lupus familiaris
PRPPSCHLRRRCPTSLKPCSKPRCCPAGWATCASTPWRSWRRSRPSGRSWCSWCGRG

SEQ ID NO: 7493-7494 - skipped (2 entries)

SEQ ID NO: 7495 - protein, 37 aa, Canis lupus familiaris
PRPRAPGKRTRWGPRPRPATPRTSTRRSSAVNAAPSC

SEQ ID NO: 7496 - protein, 26 aa, Canis lupus familiaris
PRPRGPRSPPRRGSSAQPALLPGMGL

SEQ ID NO: 7497 - protein, 36 aa, Canis lupus familiaris
PRPRPRPRSRAPRRPQPRRWLPTSCLKTTRWWRCPS

SEQ ID NO: 7498 - protein, 81 aa, Canis lupus familiaris
PRPRPWDPIPTGPPRPSQPLRTARPPWPPSCRWQTLWARRTRRRTAAPCTPPLRPPGATAAARCHRPPCPGSAAWHHGTGT

SEQ ID NO: 7499 - protein, 21 aa, Canis lupus familiaris
PRPRRRPRAGPRPRRAPTAWT

SEQ ID NO: 7500 - protein, 88 aa, Canis lupus familiaris
PRPRSAAPPPSWAVMWTGLVPPRRPPLFPSSTKAWGWLRGAFPPAGTAPPAARPVCPPSTTCPAPWCQPPLTWLQRKPPPLPLPASWN

SEQ ID NO: 7501 - skipped

SEQ ID NO: 7502 - protein, 14 aa, Canis lupus familiaris
PRPSSPPLPLRAAG

SEQ ID NO: 7503 - protein, 63 aa, Canis lupus familiaris
PRRAPWPTRTLPTSPAPAAPRTTPRNDQPRSCPPRRPPRLPCPPRPYSRGPSTPRPNGPRSRL

SEQ ID NO: 7504 - protein, 17 aa, Canis lupus familiaris
PRRESKCRMRHLLHLQL

SEQ ID NO: 7505 - protein, 28 aa, Canis lupus familiaris
PRRGAPEWGACTLSFHTLTLSLHRTPPR

SEQ ID NO: 7506 - protein, 29 aa, Canis lupus familiaris
PRRGAPEWGACTLSFHTLTLSLHRTPPSM

SEQ ID NO: 7507 - protein, 44 aa, Canis lupus familiaris
PRRGAPEWGACTLSFHTLTLSLHRTPPSSISSLPAAPLPPPGEL

SEQ ID NO: 7508 - protein, 18 aa, Canis lupus familiaris
PRRGRPPPSAQILLHESL

SEQ ID NO: 7509 - protein, 17 aa, Canis lupus familiaris
PRRGSSAQPALLPGMGL

SEQ ID NO: 7510 - protein, 90 aa, Canis lupus familiaris
PRRRRPPRAAWRCPCWSRTASRARTGPARPRPARPARSRPPRRPRRSSRSSRPARPRCTPRGPAWRPWTLRRGTSAAACWAPTCSTAGRG

SEQ ID NO: 7511 - protein, 36 aa, Canis lupus familiaris
PRRRRRRRRRPCGHTARSALRPRPRDDATARGRLSR

SEQ ID NO: 7512 - protein, 65 aa, Canis lupus familiaris
PRRRSAPLRPLLAAPREPHSPRPDTPTAALPRQAPPWAPRPGCGTPPAPLPSMPPPPLCCPCASA

SEQ ID NO: 7513 - protein, 10 aa, Canis lupus familiaris
PRRRWSSWGL

SEQ ID NO: 7514 - protein, 39 aa, Canis lupus familiaris
PRRRWTATRTSGPPSLSLPTLSASTGSWGWFSWVQGLGK

SEQ ID NO: 7515 - protein, 26 aa, Canis lupus familiaris
PRRRYLLREHIHLHPGTLLHLRGWRL

SEQ ID NO: 7516 - skipped

SEQ ID NO: 7517 - protein, 22 aa, Canis lupus familiaris
PRRSSRTPATRDTAAGACSLWG

SEQ ID NO: 7518 - protein, 35 aa, Canis lupus familiaris
PRRVPPPRLPAQAGSAGDPLAHLAGGPGWAGGISS

SEQ ID NO: 7519 - protein, 41 aa, Canis lupus familiaris
PRSCPWRCPLEVPPGALESTGTGWEQEPSQERGPSQAWEGA

SEQ ID NO: 7520 - protein, 13 aa, Canis lupus familiaris
PRSGRKKMACPCK

SEQ ID NO: 7521 - protein, 8 aa, Canis lupus familiaris
PRSMSWWH

SEQ ID NO: 7522 - protein, 18 aa, Canis lupus familiaris
PRSPSRPGTVLSWRSCMQ

SEQ ID NO: 7523 - protein, 9 aa, Canis lupus familiaris
PRSSEICAG

SEQ ID NO: 7524 - protein, 41 aa, Canis lupus familiaris
PRTGRHWTAGGLLHHVHPPGGPGDFHHTLLQEEGRHAPRGL

SEQ ID NO: 7525 - protein, 38 aa, Canis lupus familiaris
PRTLLGAPCPTCPSVPHPMTRSLCLPTARPQLRPRPSA

SEQ ID NO: 7526 - protein, 23 aa, Canis lupus familiaris
PRTLRRAPWDARSAPRRASQALA

SEQ ID NO: 7527 - protein, 34 aa, Canis lupus familiaris
PRTPRRPSRPAGRGRASSLKCICHTCLRRRRRPL

SEQ ID NO: 7528 - protein, 13 aa, Canis lupus familiaris
PRTSAGGKDHPAQ

SEQ ID NO: 7529 - protein, 12 aa, Canis lupus familiaris
PRTSCLKRPAAA

SEQ ID NO: 7530 - protein, 42 aa, Canis lupus familiaris
PRTTASPGPPAITRRCGRPTTAAARTSPTCPRPQTGTASLSC

SEQ ID NO: 7531 - protein, 41 aa, Canis lupus familiaris
PRTYPEGSRAPPVSRTQTVTARNWTTPTVAKPCSLRPPSLH

SEQ ID NO: 7532 - protein, 19 aa, Canis lupus familiaris
PRVPDCLLLRVIYPSAAGL

SEQ ID NO: 7533 - skipped

SEQ ID NO: 7534 - protein, 19 aa, Canis lupus familiaris
PRWHLPWQGQHSEPRPRPW

SEQ ID NO: 7535 - protein, 78 aa, Canis lupus familiaris
PRWPCPLASTCPASAARCGPRPPRGRPWGALAGRTASPPSCGRSRPPSSCRPPRWSRTSGRRWPWPAARSACSCTARP

SEQ ID NO: 7536 - protein, 53 aa, Canis lupus familiaris
PSAGRPDLGRRVTRGHRAPSRAGPRAAAGAPPPGPGGPHTRRGCGRRACGTPI

SEQ ID NO: 7537 - protein, 18 aa, Canis lupus familiaris
PSAVPGGAPADALSPQRL

SEQ ID NO: 7538 - protein, 18 aa, Canis lupus familiaris
PSGGDRPVPCPRRPAPAQ

SEQ ID NO: 7539 - protein, 13 aa, Canis lupus familiaris
PSGGGIQHSALQN

SEQ ID NO: 7540 - protein, 8 aa, Canis lupus familiaris
PSGPGLPG

SEQ ID NO: 7541 - protein, 38 aa, Canis lupus familiaris
PSGPGPSPSQHHVLPRSDPGVPVCLQVPAEPSEWNPDK

SEQ ID NO: 7542 - protein, 32 aa, Canis lupus familiaris
PSGPPADGAAGSSAGHPPARRAHLRRRGPARP

SEQ ID NO: 7543 - skipped

SEQ ID NO: 7544 - protein, 12 aa, Canis lupus familiaris
PSGRTKATGYVI

SEQ ID NO: 7545 - protein, 18 aa, Canis lupus familiaris
PSGSSPRPPRWSKGRPWI

SEQ ID NO: 7546 - protein, 14 aa, Canis lupus familiaris
PSGVLLGLLLLFCE

SEQ ID NO: 7547 - protein, 31 aa, Canis lupus familiaris
PSHLPHLYPLCPHRQVTMTAWKVSLPNLGSR

SEQ ID NO: 7548 - protein, 30 aa, Canis lupus familiaris
PSHLPHLYPLCPHRQVTMTWKVSLPNLGSR

SEQ ID NO: 7549 - protein, 17 aa, Canis lupus familiaris
PSHPPHPPAPPQLPQAG

SEQ ID NO: 7550 - protein, 15 aa, Canis lupus familiaris
PSKCQAPPLPPPPHR

SEQ ID NO: 7551 - protein, 73 aa, Canis lupus familiaris
PSLAWGALPYSLSVTQRTLCIFCCSSVDCWNPGVGDQPRFPCGSRFYTRGSYCESCRPMPQSRSQALLRSCPT

SEQ ID NO: 7552 - protein, 42 aa, Canis lupus familiaris
PSLAWGALPYSLSVTQRTLCIFCCSSVDCWNPGVGVSGMGQV

SEQ ID NO: 7553 - protein, 9 aa, Canis lupus familiaris
PSLRAYSII

SEQ ID NO: 7554 - protein, 54 aa, Canis lupus familiaris
PSLRRPPVFRAHVPIPGVQQRGVSGALRGLPGPAMCQAQLLLHPPECQAQLDPL

SEQ ID NO: 7555 - protein, 65 aa, Canis lupus familiaris
PSLSGGQAWDRTMESWSLRSPTHCLPTLDPRRLHPWGPFYLEFGDIPGVAGQHPRAPKTTTTTTK

SEQ ID NO: 7556 - protein, 10 aa, Canis lupus familiaris
PSPAPCPAPL

SEQ ID NO: 7557 - skipped

SEQ ID NO: 7558 - protein, 20 aa, Canis lupus familiaris
PSPGAGGRAFVTPSAARGVA

SEQ ID NO: 7559 - protein, 69 aa, Canis lupus familiaris
PSPGLSRAGPRSHVTVRPELGWRGRAPSVPHGGTEPWQGPAWPPRGPRVAWARPARPSWGRVGAARFPV

SEQ ID NO: 7560 - protein, 36 aa, Canis lupus familiaris
PSPGRSAAATAQGVLLQVPPAETSQRAPPPLQAHPP

SEQ ID NO: 7561 - protein, 86 aa, Canis lupus familiaris
PSPHLAQASRWWWPRASQPGLHLAVPGGSPRTRKKKKMMKRMRQAGGGTQGRPQMWATAWAIGGHSLRSGSASATMPSSSACSALL

SEQ ID NO: 7562 - protein, 43 aa, Canis lupus familiaris
PSPLLRLRPAPDRCRARQAPRPAPPPFVTSGGGAGRRGAGPEL

SEQ ID NO: 7563 - protein, 19 aa, Canis lupus familiaris
PSPPPRPPARGRSIWPRSV

SEQ ID NO: 7564 - protein, 42 aa, Canis lupus familiaris
PSPPPSTLFPRESRRTAGPAMPLETTFPGMQGGGGTLLSWDT

SEQ ID NO: 7565 - protein, 20 aa, Canis lupus familiaris
PSPPQSATPGATVAVPRLWY

SEQ ID NO: 7566 - protein, 30 aa, Canis lupus familiaris
PSPPVQAPVMVGRMTMPFLSLVTRKVLTVV

SEQ ID NO: 7567 - protein, 38 aa, Canis lupus familiaris
PSPRARGHVQRDRAADAPGQRHQRLRPAQPVPGAGPPG

SEQ ID NO: 7568 - protein, 31 aa, Canis lupus familiaris
PSPSSSSALWARTAALPTLLTILPGNNYPHL

SEQ ID NO: 7569 - protein, 12 aa, Canis lupus familiaris
PSPTPSPPRPCS

SEQ ID NO: 7570 - protein, 8 aa, Canis lupus familiaris
PSPVPRTR

SEQ ID NO: 7571 - protein, 11 aa, Canis lupus familiaris
PSPWTSASSAA

SEQ ID NO: 7572 - protein, 94 aa, Canis lupus familiaris
PSQAARALPSLLLDGHPAWGSEGPLPLGDRADLRGSVCPDNPGRVHRIRPSLPRARGPPVPTPGQHGSGRGAPPSQPPRALPAAPGRPGRCSAP

SEQ ID NO: 7573 - protein, 63 aa, Canis lupus familiaris
PSQCPVALAAMDTLQDLHQAQPQPAAAERPHATVPGLARGDHPGCREPHREPGHLDRVCGGEE

SEQ ID NO: 7574 - protein, 21 aa, Canis lupus familiaris
PSQPPRALPAAPGRPGRCSAP

SEQ ID NO: 7575 - protein, 26 aa, Canis lupus familiaris
PSRSPCLPCLPWAHRHPNPADLPTLT

SEQ ID NO: 7576 - protein, 17 aa, Canis lupus familiaris
PSSCPRTGKPLSWAGDP

SEQ ID NO: 7577 - protein, 10 aa, Canis lupus familiaris
PSSPSSCRRW

SEQ ID NO: 7578 - protein, 19 aa, Canis lupus familiaris
PSSPYSGLTTSLALPFFCL

SEQ ID NO: 7579 - protein, 31 aa, Canis lupus familiaris
PSTDCPSSPKTASWWSRCSARTPTRHPSKPT

SEQ ID NO: 7580 - protein, 29 aa, Canis lupus familiaris
PSTPCPTSSAAPRGPSCQRPGLCAPRTDS

SEQ ID NO: 7581 - protein, 44 aa, Canis lupus familiaris
PSTRLTLGHRELGAAPGPQICVHRWPSAARRPLGAAGTEKPRPL

SEQ ID NO: 7582 - protein, 10 aa, Canis lupus familiaris
PSTTPPRTLS

SEQ ID NO: 7583 - protein, 14 aa, Canis lupus familiaris
PSVPQVPFPLAMVL

SEQ ID NO: 7584 - protein, 8 aa, Canis lupus familiaris
PSWGPIQA

SEQ ID NO: 7585 - protein, 20 aa, Canis lupus familiaris
PSWLRQPPRQKLRNSSGYHH

SEQ ID NO: 7586 - protein, 38 aa, Canis lupus familiaris
PSWTPSRQSRATACLAPPSPSAAAKRSRRRTQGGRLSS

SEQ ID NO: 7587 - protein, 13 aa, Canis lupus familiaris
PTAHHGAQTSAGS

SEQ ID NO: 7588 - protein, 28 aa, Canis lupus familiaris
PTATATPTLCGSPRVTSPGTACRAAACA

SEQ ID NO: 7589 - protein, 17 aa, Canis lupus familiaris
PTATPPATGEDQRHRGL

SEQ ID NO: 7590 - protein, 54 aa, Canis lupus familiaris
PTCHYSLPGCRPALPSPGVLPSGRLPVSCLCPYSWAPCSLPCPARDPNGGLGAS

SEQ ID NO: 7591 - protein, 34 aa, Canis lupus familiaris
PTCTPSRLPQPWGGHRHQLCQAGLLVYSDPQPRP

SEQ ID NO: 7592 - protein, 25 aa, Canis lupus familiaris
PTCVILILILPEASQACTKEAKAGS

SEQ ID NO: 7593 - protein, 53 aa, Canis lupus familiaris
PTGAHPSAQPRASLRFPQHSTLLGPRHSHKFPVHPSPQSSCYARRSPRAPRPL

SEQ ID NO: 7594 - protein, 20 aa, Canis lupus familiaris
PTGGRRGHLLQHPACWCGCA

SEQ ID NO: 7595 - skipped

SEQ ID NO: 7596 - protein, 36 aa, Canis lupus familiaris
PTHLCRHPRPPRPPLSSSARALPMTTSWPPSRPAPS

SEQ ID NO: 7597 - protein, 41 aa, Canis lupus familiaris
PTHWPSLDCWWPPPPCASPWWPWGLSSHAASRGRETRPPWP

SEQ ID NO: 7598 - protein, 17 aa, Canis lupus familiaris
PTLMMSNGCWGWQQSWE

SEQ ID NO: 7599 - protein, 10 aa, Canis lupus familiaris
PTLRTGKRSG

SEQ ID NO: 7600 - protein, 30 aa, Canis lupus familiaris
PTLYGPHGGQGLPSQEHDPVPVAPSLRAPL

SEQ ID NO: 7601 - protein, 34 aa, Canis lupus familiaris
PTNSAPGIWYSWHLCCAPHLQCALGTSSSPSPTL

SEQ ID NO: 7602 - protein, 70 aa, Canis lupus familiaris
PTPARSPGRRFSAAAAGSCTRLPARPHACSKTCTPEPPRGARSPRRPICSRLSWPGAFPGHLSVATGNKM

SEQ ID NO: 7603 - protein, 8 aa, Canis lupus familiaris
PTPAWPSH

SEQ ID NO: 7604 - protein, 23 aa, Canis lupus familiaris
PTPGGSDGRNRAGGDRAAVLPLF

SEQ ID NO: 7605 - skipped

SEQ ID NO: 7606 - protein, 19 aa, Canis lupus familiaris
PTPHSLLTTWPCSCPSPAP

SEQ ID NO: 7607 - skipped

SEQ ID NO: 7608 - protein, 11 aa, Canis lupus familiaris
PTPKSSWGCPK

SEQ ID NO: 7609 - protein, 45 aa, Canis lupus familiaris
PTPPAPPIPAPRGAAAPSSPPSSRLHLLWRGLHGYVHQAASPYAS

SEQ ID NO: 7610 - protein, 14 aa, Canis lupus familiaris
PTPPPRSCTGYGVP

SEQ ID NO: 7611 - protein, 12 aa, Canis lupus familiaris
PTPPTTSIVRDT

SEQ ID NO: 7612 - protein, 14 aa, Canis lupus familiaris
PTPQAPCGLLQTEE

SEQ ID NO: 7613 - protein, 46 aa, Canis lupus familiaris
PTPQTEPAMPPGRSGQVRVPSMSVGTPAKPTSPGTGRRGASRDPWP

SEQ ID NO: 7614 - protein, 59 aa, Canis lupus familiaris
PTPRFGQPFTVQVAWPADSGSPWGAEGPQQHYLKAGRMPPSESCQGREAHADISAKPWW

SEQ ID NO: 7615 - protein, 58 aa, Canis lupus familiaris
PTPRFGQPFTVQVAWPADSGSPWGAEGPQQHYLKAGRMPPSESCQGREAHDISAKPWW

SEQ ID NO: 7616 - protein, 14 aa, Canis lupus familiaris
PTPRIRGRPKGSSA

SEQ ID NO: 7617 - skipped

SEQ ID NO: 7618 - protein, 11 aa, Canis lupus familiaris
PTPTCGSTGLP

SEQ ID NO: 7619 - skipped

SEQ ID NO: 7620 - protein, 11 aa, Canis lupus familiaris
PTPTPRRCPQM

SEQ ID NO: 7621 - protein, 56 aa, Canis lupus familiaris
PTPTRAPRTQTARSPPPPPTPPPCCPPAPPSPPPSSPAGPRPRGAAPGVCGRGRGG

SEQ ID NO: 7622 - protein, 30 aa, Canis lupus familiaris
PTPVRLGVPPGSDTLPHGSSSKSERGPIPP

SEQ ID NO: 7623 - protein, 68 aa, Canis lupus familiaris
PTPWCVPLRGLCGRARSRGRPTPCAPSPHSTRHQWWGNRGPRSCSSHCRSQTQESQQARGGLRGAPSP

SEQ ID NO: 7624 - protein, 26 aa, Canis lupus familiaris
PTQAPQKSGSQWAEETKQQGEKRPVF

SEQ ID NO: 7625 - protein, 16 aa, Canis lupus familiaris
PTQCPTKQPALLPKPF

SEQ ID NO: 7626 - protein, 44 aa, Canis lupus familiaris
PTQGPPSAASCTSWVRRGPPGSPGGRPGLGGGHLVLMMGGTWAR

SEQ ID NO: 7627 - protein, 51 aa, Canis lupus familiaris
PTQPRPGPGDHPSLPNGGRPGPLRLPAARPSAAGGGWQSGSARQASIPGAG

SEQ ID NO: 7628 - protein, 45 aa, Canis lupus familiaris
PTRPPCPSLPPACLERRHNTGPPPRGGSTPTPTCPATLTPTCPHT

SEQ ID NO: 7629 - protein, 12 aa, Canis lupus familiaris
PTSARTELGCWA

SEQ ID NO: 7630 - protein, 71 aa, Canis lupus familiaris
PTSCPRKGKSERLWSPGSGWAAMDWAPQICQGSPWPGWWLHWLLTAKCWSCRWWTRRLGLWRPSSWCTVAS

SEQ ID NO: 7631 - protein, 38 aa, Canis lupus familiaris
PTSHPPCSGCLPPQCPPRPTASTHPDWSPSGASSTLTV

SEQ ID NO: 7632 - protein, 22 aa, Canis lupus familiaris
PTSLAAPAQAPGLLAPCPGLLS

SEQ ID NO: 7633 - protein, 56 aa, Canis lupus familiaris
PTSLRREKDGPTSGGSPSGPKSLRPPVWAPPTPSPTTRVWPPRRQPCAHGLWLGSI

SEQ ID NO: 7634 - protein, 11 aa, Canis lupus familiaris
PTSPASQQHQL

SEQ ID NO: 7635-7636 - skipped (2 entries)

SEQ ID NO: 7637 - protein, 10 aa, Canis lupus familiaris
PTTPATRPQY

SEQ ID NO: 7638 - protein, 33 aa, Canis lupus familiaris
PTTPPPLLVLPWPHPAPTPTPAAGARAPWGLRC

SEQ ID NO: 7639 - protein, 9 aa, Canis lupus familiaris
PTTSIVRDT

SEQ ID NO: 7640 - protein, 27 aa, Canis lupus familiaris
PTTTTSSPRRSPALRARGGTTIGEVTS

SEQ ID NO: 7641 - protein, 9 aa, Canis lupus familiaris
PTTTTTKPH

SEQ ID NO: 7642 - protein, 61 aa, Canis lupus familiaris
PVAPARENVRPHRWAACRPGHGIWDDGGIRTGPQDHLGAQRGAAGEVSRARHLQLLGVAAK

SEQ ID NO: 7643 - protein, 33 aa, Canis lupus familiaris
PVLLPLLRLACAGDPGASRPGPRRPARRPRGEL

SEQ ID NO: 7644 - protein, 8 aa, Canis lupus familiaris
PVLQFRPQ

SEQ ID NO: 7645 - protein, 19 aa, Canis lupus familiaris
PVLQYAPHPTGGESPSPPS

SEQ ID NO: 7646 - protein, 19 aa, Canis lupus familiaris
PVLRRRGRRAPGCRGPRSG

SEQ ID NO: 7647 - skipped

SEQ ID NO: 7648 - protein, 91 aa, Canis lupus familiaris
PVPPACPRPPTARSRARRACRAPNSALRGPKPASPLLGVLPPPWPPWLGGGVPGRSALGPPRKGRREARGGCWGGASLRVCGRAFSGEPVA

SEQ ID NO: 7649 - protein, 45 aa, Canis lupus familiaris
PVPPGESIGVGRRPLRSAARPSEATAAGSSSMGMFSSAPKNTPYP

SEQ ID NO: 7650 - skipped

SEQ ID NO: 7651 - protein, 21 aa, Canis lupus familiaris
PWGPGPPRPLSRGGPRPCAPA

SEQ ID NO: 7652 - protein, 49 aa, Canis lupus familiaris
PWPPWLGGGVPGRSALGPPRKGRREARGGCWGGASLRVCGRAFSGEPVA

SEQ ID NO: 7653 - protein, 40 aa, Canis lupus familiaris
PWRPSAPEGPQCYPGRLRVNLASGSGASPNLGPSAPQIHL

SEQ ID NO: 7654 - protein, 48 aa, Canis lupus familiaris
PWTIPPVPLTWTTHPVIKPHFPLWRLWPWAQESPSSCLVFPASSFSES

SEQ ID NO: 7655 - protein, 51 aa, Canis lupus familiaris
PWTIPPVPLTWTTHPVIKPHFPLWRLWPWAQESPSSCLVFPASSFSVLTES

SEQ ID NO: 7656 - protein, 33 aa, Canis lupus familiaris
PWTPWPLTVPQPTNSSRNDARGSARQRAPRRGG

SEQ ID NO: 7657 - protein, 80 aa, Canis lupus familiaris
PWTPWPLTVPQPTNSSRNDARGSARQRAPRRGGPEPCHCGSCSGQPPAQCQPTARPRYPSASRPHGPEPRHSHPCATSTV

SEQ ID NO: 7658 - protein, 58 aa, Canis lupus familiaris
PWTPWPLTVPQPTNSSRNDARGSARQRAPRRGGPRYPSASRPHGPEPRHSHPCATSTV

SEQ ID NO: 7659 - protein, 24 aa, Canis lupus familiaris
QAEAPASPVYLGPTATQTQQTSQR

SEQ ID NO: 7660 - skipped

SEQ ID NO: 7661 - protein, 8 aa, Canis lupus familiaris
QAGQHRRD

SEQ ID NO: 7662 - protein, 27 aa, Canis lupus familiaris
QASPGVKPGTERWRVGAYAALLTVSQR

SEQ ID NO: 7663 - protein, 53 aa, Canis lupus familiaris
QCGNPSLDSILGQRCTTRAASRGRGLGLRHLPAGLRAEQDLWSQAGVCAEPQA

SEQ ID NO: 7664 - protein, 17 aa, Canis lupus familiaris
QCQYSVPPIGGAWRQPL

SEQ ID NO: 7665 - protein, 66 aa, Canis lupus familiaris
QGASEDLLHCCRAQHQWGRRGPAHSGCPRQTSQQLRLANLSAKAGRAGHPQVSRAPRSAPWPAQRL

SEQ ID NO: 7666 - protein, 66 aa, Canis lupus familiaris
QGDGGAVGVCKASRLPCIRGQRWLPPGPGQSRGNSSRPYPAAPPPGHQDCSIPPEQSDQLGGKWHL

SEQ ID NO: 7667 - protein, 20 aa, Canis lupus familiaris
QHPCQAWGRPATGAHFRRGQ

SEQ ID NO: 7668 - protein, 13 aa, Canis lupus familiaris
QHPCQAWGRRWMC

SEQ ID NO: 7669 - protein, 76 aa, Canis lupus familiaris
QHSPAAARHHGGLLPHRPAAHQHHPPRRDPLPGRQALLGAEGSAHCQGPSKGLSPRFPKQKLFPFSSRERRSFTEI

SEQ ID NO: 7670 - protein, 11 aa, Canis lupus familiaris
QIPSVLHADGD

SEQ ID NO: 7671 - protein, 9 aa, Canis lupus familiaris
QKSVVTGGR

SEQ ID NO: 7672 - protein, 21 aa, Canis lupus familiaris
QLNAQRSSPHCCQSPSRKLWL

SEQ ID NO: 7673 - protein, 9 aa, Canis lupus familiaris
QLRRLGIRI

SEQ ID NO: 7674 - protein, 10 aa, Canis lupus familiaris
QLRVRRGWAA

SEQ ID NO: 7675 - protein, 14 aa, Canis lupus familiaris
QLTYADTHVLPALL

SEQ ID NO: 7676-7677 - skipped (2 entries)

SEQ ID NO: 7678 - protein, 53 aa, Canis lupus familiaris
QQGLRAAAPGTPRLQSLGHRPHPSKEPRTPPRRPGPACAARLDHGPASGKDSK

SEQ ID NO: 7679 - protein, 14 aa, Canis lupus familiaris
QQPQPPLRCVEVRG

SEQ ID NO: 7680 - protein, 14 aa, Canis lupus familiaris
QRPGYVAVRKVHRL

SEQ ID NO: 7681 - protein, 19 aa, Canis lupus familiaris
QSSAGGGGGLRAAGGPGAV

SEQ ID NO: 7682 - protein, 77 aa, Canis lupus familiaris
QWELPAGGRAGWRGRRRLLRAASALASDPGAVRADRAHSWARRWPPALPGQAVGQEARGADAAGDRRAFFPVLVATV

SEQ ID NO: 7683 - protein, 28 aa, Canis lupus familiaris
RAPQARARRGSRGGAVHASQAALQAALE

SEQ ID NO: 7684 - skipped

SEQ ID NO: 7685 - protein, 74 aa, Canis lupus familiaris
RGDQAPRSRSRSHCRRSETGSSGGQRGGGPGDPKAGAVPRLEQAQKEGRRQLRAAELCPRWARLHPRSPGVWKK

SEQ ID NO: 7686 - protein, 15 aa, Canis lupus familiaris
RGGAGTRPPHLVRPT

SEQ ID NO: 7687 - protein, 65 aa, Canis lupus familiaris
RGLRPRPGPQQLRGLPGRGLRSLPGPEEAPVRGAQDQSGLPRALRKWGARGTSTPAPGQGPPKRL

SEQ ID NO: 7688 - skipped

SEQ ID NO: 7689 - protein, 32 aa, Canis lupus familiaris
RGRADPGAPPAGVRPRSPPFSPGWVYKSHRSC

SEQ ID NO: 7690 - protein, 20 aa, Canis lupus familiaris
RGRRAARPLAAAGAPPLPAL

SEQ ID NO: 7691 - protein, 91 aa, Canis lupus familiaris
RGSRRAPSPAALARRRGRRGSQTRLGAAEQVPRLDQPAVPRPAAGPTPAPALPARLGPSTPAGTSRSRGPPGRGRCCLRSACGARGRSRSL

SEQ ID NO: 7692 - skipped

SEQ ID NO: 7693 - protein, 45 aa, Canis lupus familiaris
RLPGLWGRSSRGGSHGRREAGGGGVRGHRCSGRLRGPDAPGRWDV

SEQ ID NO: 7694 - protein, 33 aa, Canis lupus familiaris
RPAGGPRHRRPGPRARPARRRREEPGRGSRGPH

SEQ ID NO: 7695 - protein, 33 aa, Canis lupus familiaris
RPAGPRAARDRAAGRPEGGRRGPPGRAAGNSGE

SEQ ID NO: 7696 - protein, 19 aa, Canis lupus familiaris
RPRAGPSTCTRPLRDPAQQ

SEQ ID NO: 7697 - skipped

SEQ ID NO: 7698 - protein, 51 aa, Canis lupus familiaris
RRHGSPQRPGLQHQRAQDPEPPLPLLPGQGARAGAPQPAAREAAAAGAGGG

SEQ ID NO: 7699 - protein, 23 aa, Canis lupus familiaris
RRPAAPGLAAHRPRPLPPRPGVR

SEQ ID NO: 7700 - protein, 71 aa, Canis lupus familiaris
RRPAGPPSGPLKARPRLGRGGRCGSQGNLASALVPPSFCEHALQWGGLSHRWSAAVPGRTSGDTEPRGSEW

SEQ ID NO: 7701 - protein, 63 aa, Canis lupus familiaris
RRPRPQRRRHQARHHGQRRRERRPGRPHIGGACRRGQEGHRNEGFGNSKMVQCKKRIWFHQQE

SEQ ID NO: 7702 - skipped

SEQ ID NO: 7703 - protein, 69 aa, Canis lupus familiaris
RRRRPGPGRAQVPEGQRAAGQRAPGRGHPGGHEQAALRGPRHPGPAAPRRPAAPQALPAAAAAARGPAA

SEQ ID NO: 7704 - protein, 11 aa, Canis lupus familiaris
RRTLQHHVSVL

SEQ ID NO: 7705 - skipped

SEQ ID NO: 7706 - protein, 48 aa, Canis lupus familiaris
RTQRTGRSWGEAEPRAAGARRGADRGRVLAPRHTHPFLSRGVAPAPQG

SEQ ID NO: 7707 - skipped

SEQ ID NO: 7708 - protein, 60 aa, Canis lupus familiaris
HHCGARSPVQQRGVPRPPPGGPAVCGCHTGAAGAGAHLCPQDLPLHLVLQVLRPVPHGPK

SEQ ID NO: 7709 - protein, 25 aa, Canis lupus familiaris
HHGQPELQGSPGLRDPRGGSRYFAC

SEQ ID NO: 7710 - protein, 75 aa, Canis lupus familiaris
HPGSAGGPQSRTPRRAQGPAVSPAAPNARRTGRPETPPPPQCPTPRCAHRPQSSRPRSAPPPRSARRPQGPTPRI

SEQ ID NO: 7711 - protein, 28 aa, Canis lupus familiaris
HSASQHWQVERGQASDRNWRGVSAPANL

SEQ ID NO: 7712 - skipped

SEQ ID NO: 7713 - protein, 62 aa, Canis lupus familiaris
PAAPRRHHVPAPRALYPSAPLAAPGPAPGCPAPRTRAGRAGGPEPTSVRWNQTCLLDTPALP

SEQ ID NO: 7714 - protein, 75 aa, Canis lupus familiaris
PALPPWTSDPTLLGHISAPPTPTRAPRTQTARSPPPPPTPPPCCPPAPPSPPPSSPAGPRPRGAAPGVCGRGRGG

SEQ ID NO: 7715 - protein, 28 aa, Canis lupus familiaris
PAPLRCWPFWRGGAPCPRCPSALCRRRT

SEQ ID NO: 7716 - protein, 87 aa, Canis lupus familiaris
PAPRPASGTPRGRPPRAPARPSHGGPAPDAAPAAGDLGPSCPTPPSAPRGPPPRRVPPPRLPAQAGSAGDPLAHLAGGPGWAGGISS

SEQ ID NO: 7717 - protein, 22 aa, Canis lupus familiaris
PAPRPLSACHYPSSNPDDKHPL

SEQ ID NO: 7718 - protein, 80 aa, Canis lupus familiaris
PDAAHGGHRPDRHRGPEEDHHPGAGGLHGPHLAQLLWRLPLSPVHDGCRQPHSAVRILCATPGSSFCRRTRRSISPDTLQ

SEQ ID NO: 7719 - protein, 22 aa, Canis lupus familiaris
PEASRGAQPPSRRPPLAQQADL

SEQ ID NO: 7720 - protein, 9 aa, Canis lupus familiaris
PFPGPPPPP

SEQ ID NO: 7721 - protein, 9 aa, Canis lupus familiaris
PFRGARGRV

SEQ ID NO: 7722 - skipped

SEQ ID NO: 7723 - protein, 37 aa, Canis lupus familiaris
PGALSALHITPSHWGAGLRALLGWVDWGPEARPCPPV

SEQ ID NO: 7724 - protein, 8 aa, Canis lupus familiaris
PGDPELPW

SEQ ID NO: 7725 - protein, 14 aa, Canis lupus familiaris
PGFPPWGRPGPKNC

SEQ ID NO: 7726 - protein, 82 aa, Canis lupus familiaris
PGGAAPRTHPPGPPYSVPPSCRRRGGPRRCSRRRRRRGRGGRGGRGGRGPSPQWHSGPRGWRRQEAVGVRVHHVALGLIVLR

SEQ ID NO: 7727 - protein, 29 aa, Canis lupus familiaris
PGGLVRPGLPDLPDQRRPRLSKAPGAASS

SEQ ID NO: 7728 - protein, 24 aa, Canis lupus familiaris
PGSAGLGGHLAAVASRRTPRTPAC

SEQ ID NO: 7729 - protein, 31 aa, Canis lupus familiaris
PGSPAVPPRCQASTRALAPSPAPEWRQGGRV

SEQ ID NO: 7730 - protein, 38 aa, Canis lupus familiaris
PHLAERAALRPAGALAQAAVVVGSLQRNQGPLPAGLGL

SEQ ID NO: 7731 - protein, 35 aa, Canis lupus familiaris
PHLLPLCRALWPCRRHSWYPRRLLVEEDPLPWRKT

SEQ ID NO: 7732 - protein, 29 aa, Canis lupus familiaris
PHRPSLMLPSPPRNGASSTSLDTSTFLGI

SEQ ID NO: 7733 - protein, 9 aa, Canis lupus familiaris
PHRRPRRPS

SEQ ID NO: 7734 - protein, 10 aa, Canis lupus familiaris
PITSCTRRTL

SEQ ID NO: 7735 - protein, 19 aa, Canis lupus familiaris
PKSRAPSATTRPRRRRRPR

SEQ ID NO: 7736 - protein, 42 aa, Canis lupus familiaris
PLATSWAQGGRIPVSLKDPEAKHQISCQDPGGCSLSSSRSRG

SEQ ID NO: 7737 - protein, 8 aa, Canis lupus familiaris
PLGDPALP

SEQ ID NO: 7738 - protein, 41 aa, Canis lupus familiaris
PLGQEALTAWEPVWSMLSARTCPALRACPASETSSARHMTA

SEQ ID NO: 7739 - protein, 90 aa, Canis lupus familiaris
PLLDPSFGLRTLGPTPNCGVSSSTHLRLRLGCPHPKLPSTTSSHQGLQHCCHHTRAWGNPSWGPPSCTHHLPSPGPHSFPRELRCQVRCC

SEQ ID NO: 7740 - protein, 53 aa, Canis lupus familiaris
PLSSSRTQKAGPGHHCPGLGGGGAVHTEDVPGAAAHPRPRVPVQHVCSAPGQP

SEQ ID NO: 7741 - protein, 14 aa, Canis lupus familiaris
PMTHCASLHCLTTR

SEQ ID NO: 7742 - protein, 32 aa, Canis lupus familiaris
PNLAKPLPQWASPQLPPPRWYKWYPLALHLEV

SEQ ID NO: 7743 - protein, 51 aa, Canis lupus familiaris
PPARARCGRTRGGLGGCCARCARGAPRETLGASSPGGCGPATRQGHSSALS

SEQ ID NO: 7744 - protein, 62 aa, Canis lupus familiaris
PPARARCGRTRGGLGGCCARCARGAPRETLGASSPGGCGPATRQVGHGRLALRSPEDPAPPG

SEQ ID NO: 7745 - protein, 10 aa, Canis lupus familiaris
PPPGPALAQP

SEQ ID NO: 7746 - protein, 18 aa, Canis lupus familiaris
PPPPPPPILMVKPDAKLT

SEQ ID NO: 7747 - protein, 88 aa, Canis lupus familiaris
PPPPSARPPARWRAPPGPGTHAHSHRPPFTLPSNHLPPLGASAPPAAPVFPALPPASWPRWTTRCWATRTWLPSPRTRPSWTSSGLTS

SEQ ID NO: 7748 - protein, 76 aa, Canis lupus familiaris
PPQAPTPTPPSRSSARRIPETANPARLTAQRRSGGAPHPAFCTPKSGRRRAPPRESGSGVGGGARSRRPRPLWDPN

SEQ ID NO: 7749 - protein, 10 aa, Canis lupus familiaris
PPQQQQRGPF

SEQ ID NO: 7750 - protein, 35 aa, Canis lupus familiaris
PPRAQPAGALLRPSGGGQSAHPRPRAAEKDASPRR

SEQ ID NO: 7751 - protein, 75 aa, Canis lupus familiaris
PPRQRRRSAEPDAPQSSRSCSVPRSAQRPQNRTPGNAPPPAVPDAPLRPPPAELEAPQCPPPPQRPTPAGPDAPH

SEQ ID NO: 7752 - protein, 22 aa, Canis lupus familiaris
PQCLPALASRTWTGVRQKLERA

SEQ ID NO: 7753 - protein, 31 aa, Canis lupus familiaris
PQCLPALASRTWTGVRQKLERGLKRCCGPTA

SEQ ID NO: 7754 - skipped

SEQ ID NO: 7755 - protein, 74 aa, Canis lupus familiaris
PQCLPALASRTWTGVRQKLERGQCAGEPMTIHTSSPNMAFPLRRRMMSRGKVTLPDSANMSMAIGLKRCCGPTA

SEQ ID NO: 7756 - protein, 49 aa, Canis lupus familiaris
PQGRAASPRRRSSIPSGFTGLWWRLCIDSTSSFATKLLIKKCLNQRTLA

SEQ ID NO: 7757 - protein, 26 aa, Canis lupus familiaris
PQPSPHCPLAPGMSRASEEPQPQPQL

SEQ ID NO: 7758 - protein, 90 aa, Canis lupus familiaris
PQRDLRSSPRGPWAWSECPWHPGLSSLLRPLSYHPGWRSRPPQAQPPNLSRPDPLPARPSSNFSPSDGTPSPSSQCNKMVQAGGPRTWWA

SEQ ID NO: 7759 - protein, 96 aa, Canis lupus familiaris
PQRGRARHLTLSPRGAPPLPTRSGKGAPPRPSRSAGPARCPPCPSAGPAQCPPCPSAGPASPLPSPRSPPRPAPRRSRRAAPWRCCARAPCASASC

SEQ ID NO: 7760 - protein, 8 aa, Canis lupus familiaris
PRAAPLDK

SEQ ID NO: 7761 - protein, 77 aa, Canis lupus familiaris
PRAPRTPSSFPPRCHLPSAAPCPLQVAAHAEPWPARASCGACPCLWPSWVWATRRRRRSPSATVRAAAPAACAPSTA

SEQ ID NO: 7762 - protein, 10 aa, Canis lupus familiaris
PRECGRPADL

SEQ ID NO: 7763 - protein, 10 aa, Canis lupus familiaris
PRGAAPGTSP

SEQ ID NO: 7764 - protein, 42 aa, Canis lupus familiaris
PRGEQRARGEGPPYQAALPGCGGGCASTRPHPLQQNCLSRSV

SEQ ID NO: 7765 - protein, 53 aa, Canis lupus familiaris
PRGLPRGPAAVPPPAARATGGSVGLQRRRAPGTRRTGGAAGQAPRTAHSPRGP

SEQ ID NO: 7766-7767 - skipped (2 entries)

SEQ ID NO: 7768 - protein, 10 aa, Canis lupus familiaris
PRRGPRWAPT

SEQ ID NO: 7769 - protein, 32 aa, Canis lupus familiaris
PRRPRRRAPAASWTTSAACSTTWPTSWTPCWS

SEQ ID NO: 7770 - skipped

SEQ ID NO: 7771 - protein, 51 aa, Canis lupus familiaris
PRTRPPSPSSATAVTPQPARTGWARRCRSVSQASAVGSRRMRSPEPCWPRR

SEQ ID NO: 7772 - protein, 41 aa, Canis lupus familiaris
PSAMSIMTRRSSWRAARRRQTVWTSWSMRRWSCTRPATGTS

SEQ ID NO: 7773 - protein, 53 aa, Canis lupus familiaris
PSASLRQRPGPRRASRAGGGTSWLLSPGPTFSTGLPVPGPRPGRSARQDHRRV

SEQ ID NO: 7774 - protein, 9 aa, Canis lupus familiaris
PSGVLGGGL

SEQ ID NO: 7775 - protein, 42 aa, Canis lupus familiaris
PSLPHPGGSPGCPAPAKARQLVPGGAAGRLPGERVPGGAVLL

SEQ ID NO: 7776 - protein, 59 aa, Canis lupus familiaris
PSLWCPIPRPAARSAPPTSWRTRCVRMSYWCCRSGCASLPTRSTSPPRPPSSTTCSSWT

SEQ ID NO: 7777-7778 - skipped (2 entries)

SEQ ID NO: 7779 - protein, 27 aa, Canis lupus familiaris
PSQLLEDSEGRPGSPLPGAGGRGSRSY

SEQ ID NO: 7780 - protein, 14 aa, Canis lupus familiaris
PSRAARAPRLPGAT

SEQ ID NO: 7781 - protein, 11 aa, Canis lupus familiaris
PSRHPGSRVLC

SEQ ID NO: 7782 - protein, 50 aa, Canis lupus familiaris
PSRVWTSGRSMTSSQRKRVAFGSCTIAGPLTPSSWSSSGRTSTGARVARR

SEQ ID NO: 7783 - protein, 35 aa, Canis lupus familiaris
PTAGQEGQAEGRGYGQPLGEAGPLGRRSRRHFLGL

SEQ ID NO: 7784 - protein, 27 aa, Canis lupus familiaris
PTHTPSKSVFSLQEVAQAVPPNGCIPS

SEQ ID NO: 7785 - protein, 60 aa, Canis lupus familiaris
PTPRGRRRGRRCWRSWRQRRSSRSRCSTSPRASAATRCRAPCTPSLACSCPPAPCSALRN

SEQ ID NO: 7786 - protein, 49 aa, Canis lupus familiaris
PTPRRKTRTPRVKIPTPPKIVLPWARWISACSTTRKTTPSTVPSARPRA

SEQ ID NO: 7787 - protein, 8 aa, Canis lupus familiaris
PTSQREPH

SEQ ID NO: 7788 - protein, 38 aa, Canis lupus familiaris
PTSSPCAGPCGPAAATVGTRGDSWWRRTPCPGGRPDGY

SEQ ID NO: 7789 - protein, 27 aa, Canis lupus familiaris
PTTCATCASTKDTTSRTVPRHAPKARV

SEQ ID NO: 7790 - protein, 35 aa, Canis lupus familiaris
PTTTTTTRALLSARPSPSAPMRTSVRGCGQGRAGD

SEQ ID NO: 7791 - protein, 56 aa, Canis lupus familiaris
PTWPSLCPSGHLHSSHLPDGTSGTHWRCTWRYDPTGPTLHPDCPDSARSPAGAYIL

SEQ ID NO: 7792 - protein, 21 aa, Canis lupus familiaris
PVRVPAAAPGAAQGEPGRGRD

SEQ ID NO: 7793 - protein, 24 aa, Canis lupus familiaris
PWARRHSLLGSQCGACCLREPALP

SEQ ID NO: 7794 - protein, 18 aa, Canis lupus familiaris
PWCAFSSSHHSVSLGSGA

SEQ ID NO: 7795 - protein, 13 aa, Canis lupus familiaris
PWGTRPSPSPRRA

SEQ ID NO: 7796 - protein, 15 aa, Canis lupus familiaris
PWPLRGPKGAASQSV

SEQ ID NO: 7797 - skipped

SEQ ID NO: 7798 - protein, 13 aa, Canis lupus familiaris
QGPGPHPLPALRQ

SEQ ID NO: 7799 - protein, 14 aa, Canis lupus familiaris
QHTHLQSQYFHYRR

SEQ ID NO: 7800 - protein, 48 aa, Canis lupus familiaris
QLPHVQLPPSCPSTAPWLPGRTRQGKTGHSAPGPRRTASGHSHLTSSL

SEQ ID NO: 7801 - protein, 63 aa, Canis lupus familiaris
QLPVPPVLQQRTLHQGLSPGTPQRRGSDPVPGQKALFRRVQVSQVQEKMDERELLGQHGAGVH

SEQ ID NO: 7802 - protein, 52 aa, Canis lupus familiaris
QPLCAAGPSGEEGHRARAARAPCAGGGPEAPAYPHGRPPPCSPDHPAAAGED

SEQ ID NO: 7803 - protein, 71 aa, Canis lupus familiaris
QPPGGKPGPRGLKFRRLQKLYCPGHAGFQPALRPGKQRPPLYHQQGQGPEADGPQRASRPLCQAASAARSQ

SEQ ID NO: 7804 - protein, 43 aa, Canis lupus familiaris
RAGAGTPPFPAPRALTPAPGRFLRRGSGSGGWSPARLSRLHVG

SEQ ID NO: 7805 - protein, 48 aa, Canis lupus familiaris
RGHRPSPRAVRPPPGLWHLLRLQSGGREAESEEEGEGGWRPPEAPNSC

SEQ ID NO: 7806 - protein, 76 aa, Canis lupus familiaris
RLPPDATTSQRPVHFIRLPLWQPRARLQAARLRGQERGGLAGRSRPQCVGTRPACWIHLPCHDQLGLLHVPRRALF

SEQ ID NO: 7807-7808 - skipped (2 entries)

SEQ ID NO: 7809 - protein, 93 aa, Canis lupus familiaris
RPRPLLPPRRPALLLGGSPRRQTPRGSRRNAEAAALLTRPSAPQNPDADGPPQGSLGVGLGAGRGHVGRGRSGTPTRAPAPEPQGGLLLGARK

SEQ ID NO: 7810 - protein, 8 aa, Canis lupus familiaris
RPRPRPRF

SEQ ID NO: 7811 - protein, 21 aa, Canis lupus familiaris
RQARPRRLPAVTHRAPGSCAR

SEQ ID NO: 7812 - protein, 54 aa, Canis lupus familiaris
RRRGPGAAAPGAASEDAARAAPGVRPGRPWVLPPRAGADPRPGRVIPVPSLDEA

SEQ ID NO: 7813 - protein, 75 aa, Canis lupus familiaris
RRRGPGAAAPGAASEDAARAAPGVRPGRPWVLPPRAGADPRPGRWATDASRFAVPRTPPRPDDLRVIPVPSLDEA

SEQ ID NO: 7814 - protein, 14 aa, Canis lupus familiaris
ADGPRPLCSSPWPP

SEQ ID NO: 7815 - protein, 29 aa, Canis lupus familiaris
AVRGHWALLGWAEGLELGRPGRLGGPRAA

SEQ ID NO: 7816 - protein, 9 aa, Canis lupus familiaris
EGDRTLSTP

SEQ ID NO: 7817 - protein, 17 aa, Canis lupus familiaris
GAAGGRVPGGRAHLGCG

SEQ ID NO: 7818 - protein, 82 aa, Canis lupus familiaris
GAGARAHGRGTTATGQGASPLPAAAWTGHVAWRPPPHTPRGGGDRGGGVWRRGLTLPTGPTAPTRGGRATPKGSLNLRAGTR

SEQ ID NO: 7819 - protein, 16 aa, Canis lupus familiaris
GAPLLGPPACTQNPGC

SEQ ID NO: 7820 - protein, 9 aa, Canis lupus familiaris
GAQRGAGGA

SEQ ID NO: 7821 - protein, 20 aa, Canis lupus familiaris
GASSCCSSSSSPCPRRPARG

SEQ ID NO: 7822 - protein, 88 aa, Canis lupus familiaris
GCRRPEGAGGRRGRRTSPRHPLVSWDLFFPHSGPSLPAKPRQQPAQGLCSQLEPFARSWAANERVPAGARGHGRKGDRSSRGDSGAQW

SEQ ID NO: 7823 - protein, 12 aa, Canis lupus familiaris
GEGPARGWGGVS

SEQ ID NO: 7824-7827 - skipped (4 entries)

SEQ ID NO: 7828 - protein, 89 aa, Canis lupus familiaris
GIQGRSPRVPQPTGAPEGGPASWGGGVQGAPEEPRPRGEEGCGEPPRSPGLVREEGPWHGRRRRQVLRAGRPPRRVGPPQPPGRPTPAA

SEQ ID NO: 7829 - protein, 24 aa, Canis lupus familiaris
GLRGAEFRGVEPTWAAAEVVSPGL

SEQ ID NO: 7830 - protein, 65 aa, Canis lupus familiaris
GLSERGPPRRPFPSRVREPARPAVSRSSRRAEGHGLHLEKSFAFLLSLFKPLLSEPLEEAWFLLE

SEQ ID NO: 7831 - protein, 18 aa, Canis lupus familiaris
GPAGKGRVPAHARSRGRG

SEQ ID NO: 7832 - protein, 53 aa, Canis lupus familiaris
GRAHAHTDAARLPPGRGRAPSRRPRGPGTWRGDPPRTPHGVAGTEAAESGGGD

SEQ ID NO: 7833 - protein, 34 aa, Canis lupus familiaris
GRPYSALQPARRTPGAESGGPRGRFWRAPTSQRP

SEQ ID NO: 7834 - protein, 28 aa, Canis lupus familiaris
GRVGPPGDEQRPTSGSPLPAGGGRGRLA

SEQ ID NO: 7835 - protein, 54 aa, Canis lupus familiaris
GSARPLGPAGVGRGSGAGQAREAGRASSSLTGDRGQGTGWLPPPTGQIRGALGQ

SEQ ID NO: 7836 - protein, 61 aa, Canis lupus familiaris
GSGRAPGGRTTTNFGKPPPCWRRARAACLTRWSRCGPTSWSGCRAGRRRRRAGCIHHQRKN

SEQ ID NO: 7837-7838 - skipped (2 entries)

SEQ ID NO: 7839 - protein, 51 aa, Canis lupus familiaris
GCIISSPRWPSGSARSRCADDVSSTWASLGLFVLFSYAPALFSGGLLRSRS

SEQ ID NO: 7840 - protein, 81 aa, Canis lupus familiaris
GLLSGAPAAQTAGAASATRAAAASGPGEAPAEAASSGSRGFGSRPRPRTKGRPSAPRAAPLCSGPARPGPRLRSALCFLGR

SEQ ID NO: 7841 - protein, 23 aa, Canis lupus familiaris
GMYYFISQVAFRLSSIQMCRRCF

SEQ ID NO: 7842 - protein, 76 aa, Canis lupus familiaris
GPGAAPPSGSAAPRHPAWPRAASVLRGPGLPAGRQGPGVPPLGAGPERRRGRGRGGRGGRGRAGTARGLAGPRRRP

SEQ ID NO: 7843 - protein, 48 aa, Canis lupus familiaris
GRGCAEWAPRLSHAGPRGHPPAHWAAPPHHQPLHQADLQTDQKGHRRT

SEQ ID NO: 7844 - protein, 37 aa, Canis lupus familiaris
GRGQKNVLDSLIRLCLVSRGQKKIAESANFLISLKKM

SEQ ID NO: 7845 - protein, 12 aa, Canis lupus familiaris
GRPNRQKAPRTT

SEQ ID NO: 7846 - protein, 42 aa, Canis lupus familiaris
GVRKDLREKGAQERGKELVPRSRDKFIRLLSLVTMLFNMLKN

SEQ ID NO: 7847 - skipped

SEQ ID NO: 7848 - protein, 14 aa, Canis lupus familiaris
ALGARAQGNGDPLI

SEQ ID NO: 7849 - protein, 16 aa, Canis lupus familiaris
GCASGTRRAESALGKN

SEQ ID NO: 7850 - protein, 27 aa, Canis lupus familiaris
GETWAPNVPSRLDYISHKAPAPAPGYF

SEQ ID NO: 7851 - protein, 55 aa, Canis lupus familiaris
GRGVGIARVRPPLATFLLEASASSARGRCVLCAGPGAPDSGPGTGGRAEGHQAPL

SEQ ID NO: 7852 - protein, 46 aa, Canis lupus familiaris
GRNLGAERSLAVGLHLPQGPRPRPRVFLARGEGPASRSRAAPGATP

SEQ ID NO: 7853 - protein, 72 aa, Canis lupus familiaris
GSGSTGPGEWGPSHLRERTRREEDRPAEFMESAISGPLILRRGGVLGRGVGALPAGAALRPPEGAAAPGSQS

SEQ ID NO: 7854 - skipped

SEQ ID NO: 7855 - protein, 43 aa, Canis lupus familiaris
GVSPSFLKLKQCSTWLTSARSRSRRGSSRSLSSKDWMPLVKPL

SEQ ID NO: 7856 - protein, 22 aa, Canis lupus familiaris
GASRDSLSSPACHSQCVSHLPR

SEQ ID NO: 7857 - skipped

SEQ ID NO: 7858 - protein, 22 aa, Canis lupus familiaris
GLPGIPCPLQLATPSACLTFPV

SEQ ID NO: 7859 - protein, 27 aa, Canis lupus familiaris
GARLAAHRRRGPGLWGPPLDATVRGPA

SEQ ID NO: 7860 - skipped

SEQ ID NO: 7861 - protein, 12 aa, Canis lupus familiaris
GPKAELCPRVWK

SEQ ID NO: 7862 - protein, 23 aa, Canis lupus familiaris
GQARPDCHSPPARATATCWCWTA

SEQ ID NO: 7863 - protein, 88 aa, Canis lupus familiaris
GRPGPTVTRPQQELRQRAGAGRRDPVHRAGRVLLPGDDREPAAVQPPRPPQGADHRGRRRGRPAGGAEALVRGVRGAVRDRRGRHPGL

SEQ ID NO: 7864 - protein, 9 aa, Canis lupus familiaris
GTIRQTRTS

SEQ ID NO: 7865 - protein, 18 aa, Canis lupus familiaris
GTKGGALPSSLEVTPGPR

SEQ ID NO: 7866 - protein, 36 aa, Canis lupus familiaris
GAMHLLCREVAPGHCLPFQALPTSTTAACWEGATAK

SEQ ID NO: 7867 - protein, 77 aa, Canis lupus familiaris
GRCTCSAERLLQVTVSRSRLCQHQRPQHAGKARQRNECACAGHGDGPFGHGRTGVPRWPLRPRPPAAVLQGCPWLSF

SEQ ID NO: 7868 - protein, 8 aa, Canis lupus familiaris
DDAQGAAD

SEQ ID NO: 7869 - skipped

SEQ ID NO: 7870 - protein, 32 aa, Canis lupus familiaris
AAAAAAPGDRRPGGPGPPLCCQQQREAADTLS

SEQ ID NO: 7871 - skipped

SEQ ID NO: 7872 - protein, 13 aa, Canis lupus familiaris
AAAGSGLRGSAAG

SEQ ID NO: 7873 - protein, 38 aa, Canis lupus familiaris
AAAGSQPPPCGPPPLCGPHVPAATRRPVGPTLGCLPSI

SEQ ID NO: 7874 - protein, 36 aa, Canis lupus familiaris
AAARDAGAGLQAGGHPEQALLPGREAERQGPLPEDR

SEQ ID NO: 7875 - protein, 14 aa, Canis lupus familiaris
AAGAAEPRAVGCRV

SEQ ID NO: 7876 - protein, 71 aa, Canis lupus familiaris
AAGAAGARILWRPAAAPRPPGRPPPPPTSPPLWGQLRRPGPGGLVPARGSPTWVRRRRRRPGQPAALRGGL

SEQ ID NO: 7877 - protein, 50 aa, Canis lupus familiaris
AAGAGRGSPGAPGRPGAAPWGGPAGRRRPQPPQPRGPPRRLGRRRRRPRP

SEQ ID NO: 7878 - protein, 48 aa, Canis lupus familiaris
AAGCDPGGCGWGRPAPRPHCRLCAPRARSALPAGRNPKSLQQWRQPGS

SEQ ID NO: 7879 - skipped

SEQ ID NO: 7880 - protein, 25 aa, Canis lupus familiaris
AAGPQEPGTGQGHRGAGRACGHSAL

SEQ ID NO: 7881 - protein, 65 aa, Canis lupus familiaris
AAGSAAHAPRRGPRARRTCRGGAGQARGAGRERAVSWRDSARRRPRSHGEGLPLLWKVFPLSASP

SEQ ID NO: 7882 - protein, 23 aa, Canis lupus familiaris
AAGSHHERRGGCHVPGQGAQQEV

SEQ ID NO: 7883 - protein, 59 aa, Canis lupus familiaris
AALAQPAAVRAGARRPRVLPRAEAVALPEEGRAGELLPAAGAAAQSCRRLAAVVPTLRL

SEQ ID NO: 7884 - protein, 73 aa, Canis lupus familiaris
AALRHPHRPGLLLPGHPSQGHARAGGRRALGAGPRAHDHLGRRPQGPHAQEDQAEAQEVRGPQGCPSRRGARP

SEQ ID NO: 7885 - protein, 49 aa, Canis lupus familiaris
AAPGGGGGGARQAGRGEKLHLVRGVHCDPCGLRPGLPPGHRAAQHVLHF

SEQ ID NO: 7886 - protein, 70 aa, Canis lupus familiaris
AAQLAGGRGAAAPGRRCRGPLAQLLPRHPLRLLVRVPHAGGGGGPLRDLGPSHIASGPGHPSPPARGAGV

SEQ ID NO: 7887 - protein, 9 aa, Canis lupus familiaris
AARCGPHGA

SEQ ID NO: 7888 - protein, 8 aa, Canis lupus familiaris
AARGAGAG

SEQ ID NO: 7889 - protein, 9 aa, Canis lupus familiaris
AARGREWHV

SEQ ID NO: 7890 - protein, 8 aa, Canis lupus familiaris
AASCPVPG

SEQ ID NO: 7891 - protein, 33 aa, Canis lupus familiaris
AASPPGASGCVCRTTYPIPAPLPAAAAAPGLPP

SEQ ID NO: 7892 - protein, 21 aa, Canis lupus familiaris
AAVLPRSRETCLPLRANCHLQ

SEQ ID NO: 7893 - protein, 63 aa, Canis lupus familiaris
ACCFFLLWRRRPSPHCLLDEASGGLAGKGWESEGPRGWDAGDPLSAATGQRGLRLHGQQCRWE

SEQ ID NO: 7894 - skipped

SEQ ID NO: 7895 - protein, 30 aa, Canis lupus familiaris
ACGHQLCPMLLRLPPLSAPSRGSWGPCRWH

SEQ ID NO: 7896 - protein, 23 aa, Canis lupus familiaris
ACRSWPRCGGWCHPAAVSRSSQG

SEQ ID NO: 7897 - protein, 11 aa, Canis lupus familiaris
ACSPSSRAGGK

SEQ ID NO: 7898 - protein, 24 aa, Canis lupus familiaris
ADGANPSSAGSPQDGRGRKAESEA

SEQ ID NO: 7899 - protein, 29 aa, Canis lupus familiaris
ADLVGRHRDPLRLLGRGHPAEPCHPRAGQ

SEQ ID NO: 7900 - protein, 28 aa, Canis lupus familiaris
ADLVGRHRDPLRLLGRGHPEPCHPRAGQ

SEQ ID NO: 7901 - protein, 20 aa, Canis lupus familiaris
ADPGGALPGAGAVHGGGRGA

SEQ ID NO: 7902 - protein, 24 aa, Canis lupus familiaris
ADQQDGPGEKSDHFPVEQVPTGIP

SEQ ID NO: 7903 - protein, 18 aa, Canis lupus familiaris
AEAGAQGCHRGGHLPVGK

SEQ ID NO: 7904 - protein, 59 aa, Canis lupus familiaris
AEVVGGGQPGLQRVRAGALGPPDLLVGRSCARRHQGGWGRTQLIYSETGAPGSHREALM

SEQ ID NO: 7905 - protein, 36 aa, Canis lupus familiaris
AFELRRSGLPAGGGAGAQDGVYEVQVSPGQRQGLKN

SEQ ID NO: 7906 - protein, 54 aa, Canis lupus familiaris
AGAALAGRGRGWGCHVLAETAGQAFGESPPWSWLLREGRVSGPGQRKWHGASGG

SEQ ID NO: 7907 - protein, 73 aa, Canis lupus familiaris
AGACRAASGAAQRGGGGGGGLGGGAAKGGGSREWLGLPALHAAQHAGGQLLLCLRGPPETLAAQNTPRGPGGP

SEQ ID NO: 7908 - protein, 27 aa, Canis lupus familiaris
AGAPRSQPARLSSCYKYSPVQGEMGHQ

SEQ ID NO: 7909 - protein, 10 aa, Canis lupus familiaris
AGDPAGGASG

SEQ ID NO: 7910-7911 - skipped (2 entries)

SEQ ID NO: 7912 - protein, 9 aa, Canis lupus familiaris
AGGALFGGL

SEQ ID NO: 7913 - protein, 81 aa, Canis lupus familiaris
AGGPEAAGADPQPGPEGRLRSPPASGVPEDVPWGQVPGVRVLPLQEGEGGGGEGVLDVPGPGPAGLPQPGHHPGPAGDGDA

SEQ ID NO: 7914 - skipped

SEQ ID NO: 7915 - protein, 11 aa, Canis lupus familiaris
AGGPGQAAQCP

SEQ ID NO: 7916 - protein, 42 aa, Canis lupus familiaris
AGGQRGPAPQWAPGGVEWGCRPQPCGLEPGWRGPHAAAARLS

SEQ ID NO: 7917 - protein, 16 aa, Canis lupus familiaris
AGGRRSEPGRLPGCPL

SEQ ID NO: 7918 - skipped

SEQ ID NO: 7919 - protein, 15 aa, Canis lupus familiaris
AGHALQLPEGQKAPL

SEQ ID NO: 7920 - protein, 69 aa, Canis lupus familiaris
AGHRGLPPPPGTPPGPGLGGRQRLPPGLHGGSQHQRPEAGAPGSLADSQHGGRLQPGGRRVRGGHLRHL

SEQ ID NO: 7921 - protein, 9 aa, Canis lupus familiaris
AGKPPGRTQ

SEQ ID NO: 7922 - protein, 30 aa, Canis lupus familiaris
AGLLYGIWTPALPSRAGVPAAALAQSAASR

SEQ ID NO: 7923 - protein, 42 aa, Canis lupus familiaris
AGPGPRGAEPGGGARSLTRAARPSARAPGGGGGRSRPRGALL

SEQ ID NO: 7924 - protein, 9 aa, Canis lupus familiaris
AGPQGGTSL

SEQ ID NO: 7925 - protein, 9 aa, Canis lupus familiaris
AGPRLRPLG

SEQ ID NO: 7926 - protein, 8 aa, Canis lupus familiaris
AGRARGSG

SEQ ID NO: 7927 - protein, 12 aa, Canis lupus familiaris
AGRERGWCRAFP

SEQ ID NO: 7928 - protein, 28 aa, Canis lupus familiaris
AGRGFRGGGGRPCSRMPQHPHHLHLSHA

SEQ ID NO: 7929 - protein, 44 aa, Canis lupus familiaris
AGRGRGRPSVRGHPRAQHLLWSPGAGLLRPPLPWRGHQIRVLLC

SEQ ID NO: 7930 - protein, 13 aa, Canis lupus familiaris
AGRQGAGGGHVQP

SEQ ID NO: 7931 - protein, 18 aa, Canis lupus familiaris
AGRVGRLSAGGSRRKQCL

SEQ ID NO: 7932 - protein, 47 aa, Canis lupus familiaris
AGSCGRRGCPDLGHGGLELPRWGRRGQPWMPPRTKSLCAVSSYAFVY

SEQ ID NO: 7933 - protein, 24 aa, Canis lupus familiaris
AGSLQAPDDLLGRLCALGPGWAPG

SEQ ID NO: 7934 - protein, 28 aa, Canis lupus familiaris
AGVARPRASRRRRRGCRSAGLHDVEGFL

SEQ ID NO: 7935 - protein, 44 aa, Canis lupus familiaris
AHGGTSSPVRRQRCRRSPEAPTAGASWDQSEAGGAALCQSQAVQ

SEQ ID NO: 7936 - skipped

SEQ ID NO: 7937 - protein, 41 aa, Canis lupus familiaris
ALAHAPGLRAALRQCGTPLPSGPGLHGAVPAGGLPGRPARP

SEQ ID NO: 7938 - protein, 19 aa, Canis lupus familiaris
ALAPGRERAPGTRQRLPQS

SEQ ID NO: 7939-7940 - skipped (2 entries)

SEQ ID NO: 7941 - protein, 11 aa, Canis lupus familiaris
ANERFCQENSC

SEQ ID NO: 7942 - protein, 8 aa, Canis lupus familiaris
APAAAQRL

SEQ ID NO: 7943 - protein, 36 aa, Canis lupus familiaris
APAPAPGPSFYIPVAQGPAQTRPGSAAHSESRGEDA

SEQ ID NO: 7944 - protein, 46 aa, Canis lupus familiaris
APAPGCAHSVRLSVSASSESEEAGEELGPALRARAPLRISAAHALP

SEQ ID NO: 7945 - protein, 14 aa, Canis lupus familiaris
APEGSGLGPRLWLG

SEQ ID NO: 7946 - protein, 49 aa, Canis lupus familiaris
APGCEVQRGVFTVPGSSGGRGALPALRGKCALFPRSQRAHGASRARQRP

SEQ ID NO: 7947 - skipped

SEQ ID NO: 7948 - protein, 17 aa, Canis lupus familiaris
APGPSPLPRGAPVHAQV

SEQ ID NO: 7949 - protein, 20 aa, Canis lupus familiaris
APGRWGLQGQSQSRGQQRRV

SEQ ID NO: 7950 - protein, 15 aa, Canis lupus familiaris
APGSGGFSAAGAPCR

SEQ ID NO: 7951 - protein, 22 aa, Canis lupus familiaris
APLSWKQWGLQSFCGRPGRWLR

SEQ ID NO: 7952 - protein, 95 aa, Canis lupus familiaris
APPAAETHLLCRLHDPALLLQLPGVHRMRAPGLHGLRPLRGHLPPPALPSHHDHGALRPAGGLLLRQRLLHLYDQGVLCLQGHLLWLQRPEPLLL

SEQ ID NO: 7953 - protein, 95 aa, Canis lupus familiaris
APPAAETHLLCRLHDPALLLQLPGVHRMRAPGLHGLRPLRGHLPPPALPSHHDHGALRPAGGLLLRQRLLHLYDQGVLCLQGHVLWLQRPEPLLL

SEQ ID NO: 7954 - protein, 20 aa, Canis lupus familiaris
APPLRGACGGAARGRVGHRV

SEQ ID NO: 7955 - skipped

SEQ ID NO: 7956 - protein, 14 aa, Canis lupus familiaris
APRTRYSQQFGRCV

SEQ ID NO: 7957 - protein, 26 aa, Canis lupus familiaris
AQAGGLGDPPRPPCGAQASSAAAVGC

SEQ ID NO: 7958 - protein, 20 aa, Canis lupus familiaris
AQCKERPRDDLHHWQLLSPE

SEQ ID NO: 7959 - protein, 38 aa, Canis lupus familiaris
AQCPQNADQPGKADANTERRRQSSPASTQRPSARPTTP

SEQ ID NO: 7960 - protein, 31 aa, Canis lupus familiaris
AQPSPCSAHDCPAHLPECVHHREPPSGTTRG

SEQ ID NO: 7961 - protein, 41 aa, Canis lupus familiaris
AQRGGEGAAGRDPPGAPSLRNQGAAARAPPPARVPAHQVGK

SEQ ID NO: 7962 - protein, 9 aa, Canis lupus familiaris
AQRSSTTPV

SEQ ID NO: 7963 - skipped

SEQ ID NO: 7964 - protein, 30 aa, Canis lupus familiaris
ARAVCVLLPCGSLQTHEWAFQGSGGLGREP

SEQ ID NO: 7965 - protein, 80 aa, Canis lupus familiaris
ARCGTPIRSLRSPGNPTGPPGLCQPGNRRRFHEATGSGHQIRRHHRADPIWGHRTWGQGCQRCQTWGRWGVGVHGPRRHQ

SEQ ID NO: 7966 - protein, 24 aa, Canis lupus familiaris
AREQPLRGHRRGGQGPKGCTDQLT

SEQ ID NO: 7967 - skipped

SEQ ID NO: 7968 - protein, 43 aa, Canis lupus familiaris
ARGALGGRPGLLGAGRRGRRGAAAGALPRPVQSRCLLGRYCLR

SEQ ID NO: 7969 - protein, 12 aa, Canis lupus familiaris
ARGGAPRGGEGP

SEQ ID NO: 7970 - protein, 12 aa, Canis lupus familiaris
ARGGGRRRGPVL

SEQ ID NO: 7971 - skipped

SEQ ID NO: 7972 - protein, 57 aa, Canis lupus familiaris
ARLGPGCVRRRGCRHLSVRHLPRSSAPGTGQPRGPSAQVGLCSCRVRLHGLHRLVGL

SEQ ID NO: 7973 - protein, 77 aa, Canis lupus familiaris
ARPAGVSQPGARGAAAHQRPPAVPTDPQSEGVWRKGRASTFRSTAMAVLQMVDLLVSGGADHPGGMGGSGSSPSLGK

SEQ ID NO: 7974 - protein, 20 aa, Canis lupus familiaris
ARPERPPLLPTGPRWRPDGS

SEQ ID NO: 7975 - protein, 11 aa, Canis lupus familiaris
ARPRPHSPCRP

SEQ ID NO: 7976 - protein, 72 aa, Canis lupus familiaris
ARRAPPVHLQRVRQELLLVVGAHHPPAHPHGRAALSVPRVRPPLQPEAQPDAASAQPHGRAALPVHRVRPRL

SEQ ID NO: 7977 - skipped

SEQ ID NO: 7978 - protein, 66 aa, Canis lupus familiaris
ARRGTLSLGGLPSSPAWAPPRPPATQDVFIVPGSAVSSTGSPGPRGHRGSRGSWLTTSSPGRHPAK

SEQ ID NO: 7979 - protein, 95 aa, Canis lupus familiaris
ARRVHPRVPRGRAGGGAPHLLRRHHGAHPQHGLPRPAAAPAHAAALRPAGRALFCPDPLAAADVPGASRAAGPALLLQPEGGPGLPGLRFAHGHG

SEQ ID NO: 7980 - protein, 29 aa, Canis lupus familiaris
ARSPAAPGPAGACGHHCHLLHWLHWHRSV

SEQ ID NO: 7981 - protein, 54 aa, Canis lupus familiaris
ARVPSTVGRNFRNTTTVCSNSYSIWGTIPARNEFTGISSFISAESICNPSWSQM

SEQ ID NO: 7982 - skipped

SEQ ID NO: 7983 - protein, 48 aa, Canis lupus familiaris
ASCPGGAAALRGPARRLGRVRRRGRRVHPHAAPLGAGGRLGGTDHSRT

SEQ ID NO: 7984 - protein, 9 aa, Canis lupus familiaris
ASEGASPEA

SEQ ID NO: 7985 - protein, 21 aa, Canis lupus familiaris
ASILLCLHRLRHRHPICIVLL

SEQ ID NO: 7986 - protein, 14 aa, Canis lupus familiaris
ASLREGASRTVRQG

SEQ ID NO: 7987 - protein, 21 aa, Canis lupus familiaris
ASQAGPAWPHHHGEPRGQFAA

SEQ ID NO: 7988 - protein, 52 aa, Canis lupus familiaris
ASQSLLILQCQSSCPALEVGLPESALQPGHHAVPGHRLAGYQHHSIPGHVRV

SEQ ID NO: 7989 - skipped

SEQ ID NO: 7990 - protein, 10 aa, Canis lupus familiaris
ASRSLHAPEK

SEQ ID NO: 7991 - protein, 14 aa, Canis lupus familiaris
ATASETDVKGQGRN

SEQ ID NO: 7992 - protein, 22 aa, Canis lupus familiaris
ATASTQPGGNGDTAWTSHRRNG

SEQ ID NO: 7993 - protein, 14 aa, Canis lupus familiaris
ATGPGHRGPAGQPG

SEQ ID NO: 7994 - protein, 17 aa, Canis lupus familiaris
ATPAPYTPFTPFLRTPK

SEQ ID NO: 7995 - protein, 21 aa, Canis lupus familiaris
AVGADPTGRAGQREAHGPQEG

SEQ ID NO: 7996 - protein, 58 aa, Canis lupus familiaris
AVGQHYSDSHPQRRQRQPPQVASEPLPVLCGGNGGARHPGGPAAGPGPRPGGQCPHGI

SEQ ID NO: 7997 - protein, 9 aa, Canis lupus familiaris
AVHWSGRRI

SEQ ID NO: 7998-7999 - skipped (2 entries)

SEQ ID NO: 8000 - protein, 28 aa, Canis lupus familiaris
AVQDGSGTGHSPAEAGRPGDSMRGPGDP

SEQ ID NO: 8001 - protein, 14 aa, Canis lupus familiaris
AVSEHHGGGREAIF

SEQ ID NO: 8002 - protein, 14 aa, Canis lupus familiaris
AVSQGHVPGSARLC

SEQ ID NO: 8003 - protein, 8 aa, Canis lupus familiaris
AWFIWCQR

SEQ ID NO: 8004 - protein, 13 aa, Canis lupus familiaris
AWGLSVLQGSHPP

SEQ ID NO: 8005 - protein, 25 aa, Canis lupus familiaris
DAGARVQGRAPSLPAALSRGRHPLL

SEQ ID NO: 8006 - skipped

SEQ ID NO: 8007 - protein, 28 aa, Canis lupus familiaris
DDRVAPRAARRRASGHVRAGCAFLIFLP

SEQ ID NO: 8008 - protein, 15 aa, Canis lupus familiaris
DGCFTGAPCRGGASE

SEQ ID NO: 8009 - protein, 79 aa, Canis lupus familiaris
DGGLGCGPPSPPVGRGWRTGGRRDGSGRMRPGVRGARRRGRGESAGRFLAWEEGLRGEGLCAKCQSESGACLPEPEATC

SEQ ID NO: 8010 - protein, 24 aa, Canis lupus familiaris
DGGPRGGGAGAHGLLGHPCPPPPN

SEQ ID NO: 8011 - protein, 25 aa, Canis lupus familiaris
DGQGVGHDPHGARLDRGVRLRGGGR

SEQ ID NO: 8012 - protein, 45 aa, Canis lupus familiaris
DGTRLVAFWGTGEGGPGTLAGHQPLPWACAGTLGVVTGDQRGAEW

SEQ ID NO: 8013 - protein, 18 aa, Canis lupus familiaris
DHLLPDCSLHGFAAQKQM

SEQ ID NO: 8014 - protein, 46 aa, Canis lupus familiaris
DLDRRGPHRTRGAAHAALQNHHHPPGPHAVPRLSADEPRHAGRAHG

SEQ ID NO: 8015 - protein, 22 aa, Canis lupus familiaris
DLPASSPTTLPGALAGVLAEEL

SEQ ID NO: 8016 - protein, 11 aa, Canis lupus familiaris
DLPQPQRAPPP

SEQ ID NO: 8017 - protein, 26 aa, Canis lupus familiaris
DLQETIRPGSQSHGLQGETQLPGQRL

SEQ ID NO: 8018 - protein, 66 aa, Canis lupus familiaris
DLSRSPLSCGQGSPASGVEGRRSRRRNLSSHQAADHRGPRAPSRQVPPSHQVPVLSGDPPLAPEDQ

SEQ ID NO: 8019 - protein, 19 aa, Canis lupus familiaris
DNPLHIADLPHHHAALLWS

SEQ ID NO: 8020 - protein, 63 aa, Canis lupus familiaris
DPALPAPQRAGRCTAVSRSLRPQARPQPPPPALAAVGGTPGAPEPRLGGGEALYPPSLGLVLV

SEQ ID NO: 8021 - protein, 40 aa, Canis lupus familiaris
DPGGLPQPQRNRKTWEEQNLEPRRRDCPGRRGPGRAGDAA

SEQ ID NO: 8022 - protein, 14 aa, Canis lupus familiaris
DPGQPATSLSLPLP

SEQ ID NO: 8023 - protein, 9 aa, Canis lupus familiaris
DQQAPTPFP

SEQ ID NO: 8024 - protein, 71 aa, Canis lupus familiaris
DRGAHKAFQDSVSSCSPRPKLSVRDPGPRAQFTVRLRHAVVARKPPRRDSCPRGGFNMAKFVLAGVVKRSV

SEQ ID NO: 8025 - protein, 12 aa, Canis lupus familiaris
DSRDSSWPPGQH

SEQ ID NO: 8026 - protein, 77 aa, Canis lupus familiaris
DTAGAAASCWGVLGLHLAEGEEEKEEPWRRRRRRRRRRRRRQQWRRILRSKNSGVWEWGPSLLDTNRPWSPEARRQG

SEQ ID NO: 8027 - protein, 10 aa, Canis lupus familiaris
DYCSWDAGTL

SEQ ID NO: 8028 - protein, 9 aa, Canis lupus familiaris
EAGPHLPTP

SEQ ID NO: 8029 - protein, 36 aa, Canis lupus familiaris
EAGRGAGAALFYARGVSRQPGGSKTLRENRVFPPGR

SEQ ID NO: 8030 - skipped

SEQ ID NO: 8031 - protein, 73 aa, Canis lupus familiaris
EARGGAELRAGRAAGAAPSLAARTRAAASAGTSSGFRASRPDLSRFSATWQPARPPPRGKSMEQSVATSPWSV

SEQ ID NO: 8032 - protein, 20 aa, Canis lupus familiaris
EASPWSHTNTLPGECAASPY

SEQ ID NO: 8033 - skipped

SEQ ID NO: 8034 - protein, 23 aa, Canis lupus familiaris
EDAAGAAGGPVAEDGCGEPVRQR

SEQ ID NO: 8035 - protein, 17 aa, Canis lupus familiaris
EDGGPEHPGLQLAVRPQ

SEQ ID NO: 8036 - skipped

SEQ ID NO: 8037 - protein, 17 aa, Canis lupus familiaris
EELRPESLRRPLWGTQV

SEQ ID NO: 8038 - protein, 36 aa, Canis lupus familiaris
EGAAGRDPPGAPSLRNQGAAARAPPPARVPAHQVGK

SEQ ID NO: 8039 - protein, 70 aa, Canis lupus familiaris
EGEEQAGAEKKSWKGKEPALFPHFWLPFRGQCPRTPLPLQPHPRALLASLSSSLPVARSPETVSDTPVSV

SEQ ID NO: 8040 - protein, 32 aa, Canis lupus familiaris
EGHGEHALRWLRRWGQGQLQRGQWGGISVSRQ

SEQ ID NO: 8041 - protein, 8 aa, Canis lupus familiaris
EGVSFSPL

SEQ ID NO: 8042 - protein, 19 aa, Canis lupus familiaris
EHAEPKGPARGQRFRPVTV

SEQ ID NO: 8043 - protein, 17 aa, Canis lupus familiaris
ELWAHSTCAARGEEEGL

SEQ ID NO: 8044 - protein, 8 aa, Canis lupus familiaris
EPGRRAPR

SEQ ID NO: 8045 - protein, 27 aa, Canis lupus familiaris
EPHLQCRGWWTCPSRTSPPTTTTTKPH

SEQ ID NO: 8046 - skipped

SEQ ID NO: 8047 - protein, 44 aa, Canis lupus familiaris
EQTPCHLDRHRHPFPGVGHPGQRGLVCKEDHTRLWPGLHTHSHS

SEQ ID NO: 8048 - protein, 11 aa, Canis lupus familiaris
EQTRPFTSWQP

SEQ ID NO: 8049 - protein, 10 aa, Canis lupus familiaris
ERGREGAPSL

SEQ ID NO: 8050 - protein, 100 aa, Canis lupus familiaris
ERQDHHGGHSGASFSQLRREPLHPALCQQGQEHQEQAPGERGSQGHAAAGIPGGDRPPEGPAGEEGDAGKAAPEEEQPQEEGCVGPGWVPGGVSDRGLGG

SEQ ID NO: 8051 - protein, 39 aa, Canis lupus familiaris
ESAASKANRLFCPDCRGNGIHREKELHPPRSTSSKRSGF

SEQ ID NO: 8052 - protein, 43 aa, Canis lupus familiaris
ESCPGRFHELPGSQLLLCGPLLSCYCLHEGAQGDPSLWKRGVP

SEQ ID NO: 8053 - protein, 14 aa, Canis lupus familiaris
ESGQLSGRGFPLGD

SEQ ID NO: 8054 - protein, 58 aa, Canis lupus familiaris
ETAARIWDPWHCCLYPVHSHCCRFWSWSPHCTQGTRRIRRGCYISSYACHVVFMGSPS

SEQ ID NO: 8055 - protein, 11 aa, Canis lupus familiaris
ETADREGGPKG

SEQ ID NO: 8056 - protein, 41 aa, Canis lupus familiaris
EVPRLQPLHGQRGGQLYALHDQPAGRRRGVHQLPGRRPRVV

SEQ ID NO: 8057-8059 - skipped (3 entries)

SEQ ID NO: 8060 - protein, 48 aa, Canis lupus familiaris
GAAATAAATRRRRRSPRSSRTRPPQPPRGRSPRTRSSASSAACSPGWS

SEQ ID NO: 8061 - protein, 32 aa, Canis lupus familiaris
GAAATRRAPSAGSPSPTWPSCAEMWRSAPCSR

SEQ ID NO: 8062 - protein, 30 aa, Canis lupus familiaris
GAAATTSTSAASSAGSLWTPGRRGGTCASS

SEQ ID NO: 8063 - skipped

SEQ ID NO: 8064 - protein, 24 aa, Canis lupus familiaris
GAACVPALAAPALEAAPGRPPGAS

SEQ ID NO: 8065 - protein, 50 aa, Canis lupus familiaris
GAADLGSPAALWRSEEPPPEAGPGEQGRLGPPTPFPEVSTWSQQPRCLGL

SEQ ID NO: 8066 - protein, 27 aa, Canis lupus familiaris
GAAEGWGEGGRRARAARTRPECLPLGH

SEQ ID NO: 8067 - protein, 51 aa, Canis lupus familiaris
GAAEIKKSHLLVPSILELQLAGTGGLDCPRTHLLHPVLMGRKMKRNFWKEL

SEQ ID NO: 8068 - skipped

SEQ ID NO: 8069 - protein, 30 aa, Canis lupus familiaris
GAAGRAEPRPPRRLRRRPCRLTRAGTTRTG

SEQ ID NO: 8070 - protein, 11 aa, Canis lupus familiaris
GAAGRLRGARW

SEQ ID NO: 8071 - protein, 22 aa, Canis lupus familiaris
GAAGRRAPGPRGAAPGEAPGHR

SEQ ID NO: 8072 - protein, 28 aa, Canis lupus familiaris
GAAGRTPRTPGSPRGRSDSGGCPQHQNQ

SEQ ID NO: 8073 - protein, 17 aa, Canis lupus familiaris
GAALMMSSMACGSAESS

SEQ ID NO: 8074 - protein, 55 aa, Canis lupus familiaris
GAALPAAPRARVVITHSASVRSAPAPSPPDCTAPRATPGGGCGQRSPDPSTPGLA

SEQ ID NO: 8075 - protein, 31 aa, Canis lupus familiaris
GAARPPEGPAAAAHRSRTPRAPGPHQSQPRP

SEQ ID NO: 8076 - protein, 62 aa, Canis lupus familiaris
GAARQRSTARWTVGTISQKSPRWKVSSLPWLLWPWPLLPTMRRPLCLPAASPTLQSSWTCTR

SEQ ID NO: 8077 - protein, 32 aa, Canis lupus familiaris
GAARRGLPLSPELRSLAAQTHLPLTARPPSAA

SEQ ID NO: 8078 - protein, 15 aa, Canis lupus familiaris
GAAWRWTQRPRPCTG

SEQ ID NO: 8079 - protein, 83 aa, Canis lupus familiaris
GACATAPTPASVAVVRIQLCCTTDTPGPPTTGPSRMETCACSTWVASITASLLTSRARSRPTASSPRTRRPSMRRCCGAAVLS

SEQ ID NO: 8080 - protein, 58 aa, Canis lupus familiaris
GACELRGAAPGPAGSPPTRVDLWTPSTPVAGSGLGRRFSGCSGRARPRSPAAPPRQTR

SEQ ID NO: 8081 - protein, 30 aa, Canis lupus familiaris
GACGAQGRAHRRLCGPAALWGAGGGSGRSA

SEQ ID NO: 8082 - protein, 28 aa, Canis lupus familiaris
GACSPPSTVAWCACGAKKIPGIPLPAEH

SEQ ID NO: 8083 - protein, 27 aa, Canis lupus familiaris
GACSPSTPRAAWGTRWVSTPPFTPWPR

SEQ ID NO: 8084 - skipped

SEQ ID NO: 8085 - protein, 10 aa, Canis lupus familiaris
GAEARRRAGP

SEQ ID NO: 8086 - protein, 99 aa, Canis lupus familiaris
GAEQGLWNGGPVPHGQDPAAGARDRRGCLCQHLLRPCHRQCRDTRGGRRGDGRCDIWGRLGSAEEGPVWREEGKRAGHRGRGWCPGLEWQCRGSRQGGA

SEQ ID NO: 8087 - protein, 98 aa, Canis lupus familiaris
GAEQGLWNGGPVPHGQDPAAGARDRRGCLCQHLLRPCHRQCRDTRGGRRGDGRCDIWGRLGSAEEGPVWREEGKRAGQGRGWCPGLEWQCRGSRQGGA

SEQ ID NO: 8088 - protein, 12 aa, Canis lupus familiaris
GAEWGWPEPGSE

SEQ ID NO: 8089 - protein, 9 aa, Canis lupus familiaris
GAFCGIMYA

SEQ ID NO: 8090 - protein, 32 aa, Canis lupus familiaris
GAGARRRSAARSPSRCCSTSPPWRSSTGSCRL

SEQ ID NO: 8091 - protein, 12 aa, Canis lupus familiaris
GAGGFVTSQAQW

SEQ ID NO: 8092 - skipped

SEQ ID NO: 8093 - protein, 54 aa, Canis lupus familiaris
GAGGGKRRPRGPSKCQKPGGRLSSRDACVRGGGCSLGALPTGSPPRLRTPRRQL

SEQ ID NO: 8094 - skipped

SEQ ID NO: 8095 - protein, 33 aa, Canis lupus familiaris
GAGGQQERGARRGGGASPSALSFCHSSSATGGA

SEQ ID NO: 8096 - protein, 35 aa, Canis lupus familiaris
GAGGRPWGPPATPVRSAGLLRSGSWMLTNMRMIQN

SEQ ID NO: 8097 - protein, 23 aa, Canis lupus familiaris
GAGLRSLRHQCPASRGGRGTESP

SEQ ID NO: 8098 - skipped

SEQ ID NO: 8099 - protein, 33 aa, Canis lupus familiaris
GAGPALRGPACAARPTSGAAEGRSRPHPRQSST

SEQ ID NO: 8100 - skipped

SEQ ID NO: 8101 - protein, 45 aa, Canis lupus familiaris
GAGPLLLPGGRTEDTRTASGASCWLGICHQGASSSSPTSECPPGP

SEQ ID NO: 8102 - protein, 49 aa, Canis lupus familiaris
GAGPRGGGRKRRGRCFRARGRARWRRPWSCTAGRGAGGYRQWTWTAWPC

SEQ ID NO: 8103 - protein, 14 aa, Canis lupus familiaris
GAGRDQNKVFGPSV

SEQ ID NO: 8104 - protein, 12 aa, Canis lupus familiaris
GAGRGAYPYLNY

SEQ ID NO: 8105 - protein, 11 aa, Canis lupus familiaris
GAGRPVSSAHP

SEQ ID NO: 8106 - protein, 12 aa, Canis lupus familiaris
GAGRRAAPGTCS

SEQ ID NO: 8107 - protein, 73 aa, Canis lupus familiaris
GAGRSAANSERAVPSAGSVRPAPNCGGRRACPGPRVPRSWAALGCAALRGRGAGRPNVPRGPGGRGRDRGRSS

SEQ ID NO: 8108 - protein, 20 aa, Canis lupus familiaris
GAGSACGTSRNRTGTTGRAA

SEQ ID NO: 8109 - protein, 52 aa, Canis lupus familiaris
GAGSPGCRAASLSPVPRRRVTQSRPGRHHEVSKEGVPPQNVYSQILGGRRSL

SEQ ID NO: 8110 - protein, 69 aa, Canis lupus familiaris
GAGTAAAAHPHQPRLQRLHGVPVALGRERAQRDAQPRGRGGRRLGRLARRRRAPGTPKPGRAPARRLGR

SEQ ID NO: 8111 - protein, 28 aa, Canis lupus familiaris
GAGVEAVLPAPRPRPQVVACHVSTPQPL

SEQ ID NO: 8112 - skipped

SEQ ID NO: 8113 - protein, 32 aa, Canis lupus familiaris
GAHQSSPGARCPPGAPKSPRQRQWPRRRETVP

SEQ ID NO: 8114 - protein, 76 aa, Canis lupus familiaris
GAKRPMIYSRSWRRCGSPRPGSGRSPPWYPGPPRHHWSSLLATSTPSSAGSVRWNSRGPSLSRRSGCGTYSGTSWR

SEQ ID NO: 8115-8117 - skipped (3 entries)

SEQ ID NO: 8118 - protein, 46 aa, Canis lupus familiaris
GALHTRGAGAGTCWLWLRASSSSVRQALMGLWCPSLTFPHMKIPHG

SEQ ID NO: 8119 - protein, 42 aa, Canis lupus familiaris
GALKNVAASRSMGSTQRSPTMWTGCGNRWAPHKVWGTSKWNG

SEQ ID NO: 8120 - skipped

SEQ ID NO: 8121 - protein, 17 aa, Canis lupus familiaris
GALPTCKMWWSRRSSGC

SEQ ID NO: 8122 - protein, 20 aa, Canis lupus familiaris
GALQLLSLDWSVPHSWTGLY

SEQ ID NO: 8123 - protein, 57 aa, Canis lupus familiaris
GALQSWALGRLGQAGRTSHPGKMDMCPSTHPAQCRQPSTVLGATQMQVSLAKFTPAR

SEQ ID NO: 8124 - protein, 53 aa, Canis lupus familiaris
GALTAACRSAQPTAAAMAPVPRPWDHAVVSLASWDVPVTCTCGRTRALAGGTM

SEQ ID NO: 8125 - protein, 10 aa, Canis lupus familiaris
GALWAIRRSC

SEQ ID NO: 8126 - protein, 45 aa, Canis lupus familiaris
GALWPLHPRLPGHRRLGEGARRRRVCVRLHLCPWQWLPGDRRRSP

SEQ ID NO: 8127 - protein, 74 aa, Canis lupus familiaris
GALYCGSKRVTTFSPHGQPWKMSSPLLSRTMQPTWVTLFPPCFCGVDAASFSQGLLGLDTEERSSPSSLRKMGL

SEQ ID NO: 8128 - protein, 99 aa, Canis lupus familiaris
GAMGSRIRPLSPGLPRGITATTPTRIASCPWMSRAAHTPPPTRQTVRTMGWRLRTNGTQLGALSTAPPKWMPQPTTSRPAGPTRAWRGATARSLETSRA

SEQ ID NO: 8129 - protein, 23 aa, Canis lupus familiaris
GANASFHQLAALNSPWRPSSKKG

SEQ ID NO: 8130 - protein, 24 aa, Canis lupus familiaris
GAPAAGRSHPSPLRPRPPPCETPS

SEQ ID NO: 8131 - protein, 16 aa, Canis lupus familiaris
GAPARSRAGAVAQGPS

SEQ ID NO: 8132 - protein, 18 aa, Canis lupus familiaris
GAPASCPHTCRACETSWR

SEQ ID NO: 8133 - protein, 72 aa, Canis lupus familiaris
GAPCHWLLFHFRSRPMIPASGTRGTASPSSARHPHAPRTGTKSETSSTRSPPSWTPAWCTAARTLWPLGFET

SEQ ID NO: 8134 - protein, 11 aa, Canis lupus familiaris
GAPCPPSSGGG

SEQ ID NO: 8135 - protein, 17 aa, Canis lupus familiaris
GAPERSSRYHHRDQHPR

SEQ ID NO: 8136 - protein, 92 aa, Canis lupus familiaris
GAPGAATAPAERPSGGRGRAAPSGAERHRAGPSGAERGRAAPSGAERGRVPGGRGRAEPNRGRAEPSSWRAGPKAAESKRAAGCRRRWSSST

SEQ ID NO: 8137 - protein, 72 aa, Canis lupus familiaris
GAPGPRPPRSHHRCCRPRPRAPTRRWAVRRRPRCCPPQPLPPSRWSRRTSTCPNSWPRRTRSTRPSLTPCSY

SEQ ID NO: 8138 - protein, 15 aa, Canis lupus familiaris
GAPGWSWTPPSTPCA

SEQ ID NO: 8139 - protein, 30 aa, Canis lupus familiaris
GAPIEEEVGPGAYSLFPEPRRPGLPNFLAG

SEQ ID NO: 8140 - skipped

SEQ ID NO: 8141 - protein, 53 aa, Canis lupus familiaris
GAPPAAEPRPGPRGPSSPRSRCMPSCSSWTWRVASVQNIHCTSSPCGWVFARS

SEQ ID NO: 8142 - protein, 21 aa, Canis lupus familiaris
GAPPAGPCPPPRARPSAPRAP

SEQ ID NO: 8143 - protein, 20 aa, Canis lupus familiaris
GAPPRPTGVTGCPGRRRGPS

SEQ ID NO: 8144 - protein, 48 aa, Canis lupus familiaris
GAPRKMTLLQLRRLMIRSWRWLLCLAVCRWPSLVSLSCSITESPSVAR

SEQ ID NO: 8145 - protein, 55 aa, Canis lupus familiaris
GAPRPVQVGVTGRGRGRERLSRRRSPRAGYGAVPAKARGYPRRCFLRPRKICLLS

SEQ ID NO: 8146 - protein, 25 aa, Canis lupus familiaris
GAPRTPGSRGSFCRSQRSGRTFTST

SEQ ID NO: 8147 - protein, 53 aa, Canis lupus familiaris
GAPSWFRWAMASASCRSSAWWRTTRWGQTCWRRRSPSSRSTCRVWTLLLSTRS

SEQ ID NO: 8148 - protein, 62 aa, Canis lupus familiaris
GAPTPARRKKKQLSVTYVSLVFSAISLLVNSWRDWLLKKKAGWWSPQTVLRIASFLPDQTSL

SEQ ID NO: 8149 - protein, 29 aa, Canis lupus familiaris
GAQEPLGRPCPAQPVAASSASPTTSPATG

SEQ ID NO: 8150 - protein, 14 aa, Canis lupus familiaris
GAQGLSRLQWQRQQ

SEQ ID NO: 8151 - skipped

SEQ ID NO: 8152 - protein, 42 aa, Canis lupus familiaris
GAQNQKCSISWRALPCLTPHVPRCWAAASAAPWSPRLSRGSL

SEQ ID NO: 8153 - protein, 11 aa, Canis lupus familiaris
GAQRHVRSGSL

SEQ ID NO: 8154 - skipped

SEQ ID NO: 8155 - protein, 56 aa, Canis lupus familiaris
GAQTLQGRRPSLGPTSGALGSRPRPRPWGRFTPHSLQREGVTPFRWGAGGSATAAS

SEQ ID NO: 8156 - protein, 45 aa, Canis lupus familiaris
GARAAARRRGRRCAAATGAPTPACASCAPRTARRVSGARSRPCRC

SEQ ID NO: 8157 - protein, 12 aa, Canis lupus familiaris
GARAAPPPWPGP

SEQ ID NO: 8158 - protein, 39 aa, Canis lupus familiaris
GARAARPAPTPAAPRPVPAAAATRAPTAASSAAARPPPA

SEQ ID NO: 8159 - protein, 55 aa, Canis lupus familiaris
GARAHAAPLPSFRRRGPAGRAPRAPVRPGRVSAASPSPGAVALLGAAPTWRLAAP

SEQ ID NO: 8160 - protein, 12 aa, Canis lupus familiaris
GARAPGGAWAPR

SEQ ID NO: 8161 - protein, 53 aa, Canis lupus familiaris
GARARARRGAGCLPQRRGCRRPARRRRWRRCCPSWRPGPGRTCGPRRCGTCWR

SEQ ID NO: 8162 - protein, 21 aa, Canis lupus familiaris
GAREGGGSESLTGVLSFLRTL

SEQ ID NO: 8163 - protein, 52 aa, Canis lupus familiaris
GAREMGPSRSKPVPRTAEESLRQLLKGPREVWARPGRALLSQGGQRLRQQRS

SEQ ID NO: 8164 - protein, 16 aa, Canis lupus familiaris
GARGAGELGGPSRSRR

SEQ ID NO: 8165 - skipped

SEQ ID NO: 8166 - protein, 22 aa, Canis lupus familiaris
GARGAQGSCKGTTLPASHRMRG

SEQ ID NO: 8167 - protein, 48 aa, Canis lupus familiaris
GARGPPARPTRTSTRSTWTVRKGNWFTCCPTGLRICCTCCWPGTRSAY

SEQ ID NO: 8168 - protein, 66 aa, Canis lupus familiaris
GARGPRTPPPPPSGSARAASSTSRRTAGCTPTPGSWGPGSPTSCGTWAASKSSAPCALWILTLAPR

SEQ ID NO: 8169 - protein, 33 aa, Canis lupus familiaris
GARIPSTTSEPCSGAAAWSPCIRCAAPPSTSKP

SEQ ID NO: 8170 - protein, 100 aa, Canis lupus familiaris
GARISTKTAMWMSPRPRTPLRPRSPRVRRAPQPEAGHPPTPLPEEPLASPVFQLRVPSASLSISSPTSPQRSRRQSPPGPAQGPRWKGRPRPPSSPSTWR

SEQ ID NO: 8171 - protein, 65 aa, Canis lupus familiaris
GARLPHAAQRLPQGGGRRRHGHGHRAARRARARPARARRAGPRDPGQGGRRLQHQHAQQENHAGV

SEQ ID NO: 8172 - protein, 32 aa, Canis lupus familiaris
GARPPSTPLTCPPPPPSLSPRSSCWTRIWTSP

SEQ ID NO: 8173 - skipped

SEQ ID NO: 8174 - protein, 11 aa, Canis lupus familiaris
GARRTNPGENP

SEQ ID NO: 8175 - protein, 39 aa, Canis lupus familiaris
GARSASSQTSRTPPPRSSSLLPITQKEIWTSLTSHLELL

SEQ ID NO: 8176 - skipped

SEQ ID NO: 8177 - protein, 22 aa, Canis lupus familiaris
GARTGSSWTGSCRQGWRWNGSD

SEQ ID NO: 8178 - protein, 14 aa, Canis lupus familiaris
GASCGRAATASSPG

SEQ ID NO: 8179 - protein, 53 aa, Canis lupus familiaris
GASGARETTGQRARTPRKACPSQVFPRCCPHSYSTLERVSPGGAGRPVSSAHP

SEQ ID NO: 8180 - protein, 17 aa, Canis lupus familiaris
GASGEWFVETPPRMLSF

SEQ ID NO: 8181 - protein, 12 aa, Canis lupus familiaris
GASGPDTASPCR

SEQ ID NO: 8182-8183 - skipped (2 entries)

SEQ ID NO: 8184 - protein, 14 aa, Canis lupus familiaris
GASQSPHQPLSPRT

SEQ ID NO: 8185 - protein, 49 aa, Canis lupus familiaris
GASSAMQGLVDLPQQDIPPHHHHYQTPLRRREWKQESRSRMMTWALVFF

SEQ ID NO: 8186 - protein, 8 aa, Canis lupus familiaris
GASSATRT

SEQ ID NO: 8187 - protein, 36 aa, Canis lupus familiaris
GASTRTAHPRASLPTTCFTSRLQNWPFWPPSKPSAS

SEQ ID NO: 8188 - protein, 35 aa, Canis lupus familiaris
GASTSGRRHPKKHMTWSTLSTAMERRRRFTWKLIL

SEQ ID NO: 8189 - protein, 42 aa, Canis lupus familiaris
GASTTAPAICCTGGRRLPTAASCARRSASSTCTTISLSTTSG

SEQ ID NO: 8190 - protein, 36 aa, Canis lupus familiaris
GATAALPRPRPGRPKSTRSSRSSRSSRSPRRRRGRS

SEQ ID NO: 8191 - protein, 49 aa, Canis lupus familiaris
GATAARTSAASRRARARPARRPRTPAAPRSRPGCPALCSASCSWRPTTS

SEQ ID NO: 8192 - protein, 43 aa, Canis lupus familiaris
GATADRWAAGPTRGAPGAHIAASDASPQTQNSRITSELEEQPT

SEQ ID NO: 8193 - protein, 37 aa, Canis lupus familiaris
GATLRVLPRRNAPQSTSHRNLKPKTLLSPLCKNSSPW

SEQ ID NO: 8194 - protein, 14 aa, Canis lupus familiaris
GATPASTPPTSCPT

SEQ ID NO: 8195 - protein, 8 aa, Canis lupus familiaris
GATPPTKG

SEQ ID NO: 8196 - skipped

SEQ ID NO: 8197 - protein, 27 aa, Canis lupus familiaris
GATSTHRCSSCGAWTCPSCSLTSPGIS

SEQ ID NO: 8198 - protein, 14 aa, Canis lupus familiaris
GAVEEHTEVAFHLD

SEQ ID NO: 8199 - protein, 12 aa, Canis lupus familiaris
GAVISGAARADA

SEQ ID NO: 8200 - protein, 38 aa, Canis lupus familiaris
GAVQMSWRLPCPPGRAEERMVVGGRQAARAGVARRRRS

SEQ ID NO: 8201 - protein, 21 aa, Canis lupus familiaris
GAVTSAPVTSMAWQPRAQGTL

SEQ ID NO: 8202 - protein, 72 aa, Canis lupus familiaris
GAWPRGEERAGARGGRKCASRARGGAPPRPEAEVAPRRRPRFCWRAGVRRAGGGASPGGGAGFPGNGAPAPC

SEQ ID NO: 8203 - protein, 72 aa, Canis lupus familiaris
GAWRPQLHEVQWVVQRLPCRQVQPLWIQHHQEAPLTPSQDRRKLGLWRRKNPSLGLRTRGWMVWLPVRPWSM

SEQ ID NO: 8204 - protein, 70 aa, Canis lupus familiaris
GAWRPQLHEWVVQRLPCRQVQPLWIQHHQEAPLTPSQDRRKLGLWRRKNPSLGLRTRGWMVWLPVRPWSM

SEQ ID NO: 8205 - protein, 19 aa, Canis lupus familiaris
GCALHLTSPLHPPLPAALQ

SEQ ID NO: 8206 - protein, 37 aa, Canis lupus familiaris
GCAPASASPRAPTSGSPFSRPRPCRWTASPGCRPPGT

SEQ ID NO: 8207 - protein, 8 aa, Canis lupus familiaris
GCCCCCSW

SEQ ID NO: 8208 - protein, 28 aa, Canis lupus familiaris
GCCGAERPHPGRRHHPRSQRPALGGPEL

SEQ ID NO: 8209 - protein, 10 aa, Canis lupus familiaris
GCCLTRAVIL

SEQ ID NO: 8210 - protein, 44 aa, Canis lupus familiaris
GCCPPEVERDVSSSSSKLSSSVRPWEEEYGVEHRPDMCTRTASR

SEQ ID NO: 8211 - protein, 28 aa, Canis lupus familiaris
GCFIKPPPPQRWTTVLRGPLHGMQETRP

SEQ ID NO: 8212 - protein, 20 aa, Canis lupus familiaris
GCFLPSSRLSAEVPGSLRTL

SEQ ID NO: 8213 - protein, 92 aa, Canis lupus familiaris
GCGGIRPPRKRGWMITGTSPSLTLLGKPPGLWSRWGAETATPRPAQSRRPSVGFGPTCSQSSDTTMAPRRTRRRWGGRRRRPAGGWRVPWGG

SEQ ID NO: 8214 - protein, 11 aa, Canis lupus familiaris
GCGPALRQARG

SEQ ID NO: 8215 - protein, 50 aa, Canis lupus familiaris
GCGSWRGRGCGGSAPWPRRARLARSALGTRGLRSGRNRAGVGSAYRPLRW

SEQ ID NO: 8216 - protein, 53 aa, Canis lupus familiaris
GCHPAPLSPISACPRLLPSPSHVLALAATFPRETAMPQMQHQALVMWEKGWHA

SEQ ID NO: 8217 - protein, 11 aa, Canis lupus familiaris
GCHRGGSAQRI

SEQ ID NO: 8218 - protein, 11 aa, Canis lupus familiaris
GCHRPAPVSAP

SEQ ID NO: 8219 - protein, 14 aa, Canis lupus familiaris
GCILGQVSVHWGYI

SEQ ID NO: 8220 - skipped

SEQ ID NO: 8221 - protein, 86 aa, Canis lupus familiaris
GCLPQWGPAGWLRACGSGWREPGAAITEAPSFPDKLDVKDKVLLDSLCHLLTAPHLPGQGDVGRKPRSGAWDWWTLSHVPYSAPKH

SEQ ID NO: 8222 - protein, 47 aa, Canis lupus familiaris
GCPAGGWAWCGCARTPVPRATRTAATTTPAQASGTCAARRGWRGTTA

SEQ ID NO: 8223 - protein, 26 aa, Canis lupus familiaris
GCPAHPQDPSPQGPPKTAAPRSLPVL

SEQ ID NO: 8224 - skipped

SEQ ID NO: 8225 - protein, 17 aa, Canis lupus familiaris
GCPLVRQENLITQDHKL

SEQ ID NO: 8226 - protein, 15 aa, Canis lupus familiaris
GCPPAIPWAYSRTET

SEQ ID NO: 8227 - protein, 89 aa, Canis lupus familiaris
GCPPAPAPGTDRLARPGLGLPAPRGQGQGQLHRGCGQGSSQQHPQRLARGAGCVSQAQHQCACEHGRLALQGGRLRCPEDPPGQVQLQH

SEQ ID NO: 8228 - skipped

SEQ ID NO: 8229 - protein, 9 aa, Canis lupus familiaris
GCPSLTAPV

SEQ ID NO: 8230 - protein, 16 aa, Canis lupus familiaris
GCQPGACPWVCKALLR

SEQ ID NO: 8231 - protein, 23 aa, Canis lupus familiaris
GCQQVPGAVTVCAHGLWHHGCGL

SEQ ID NO: 8232 - protein, 10 aa, Canis lupus familiaris
GCQRSRCGLS

SEQ ID NO: 8233 - protein, 10 aa, Canis lupus familiaris
GCRCLRSGVK

SEQ ID NO: 8234 - protein, 27 aa, Canis lupus familiaris
GCRDSADPQWRWPKVLVCPQRQPAVLL

SEQ ID NO: 8235 - protein, 13 aa, Canis lupus familiaris
GCRGEPFSLAPAL

SEQ ID NO: 8236 - protein, 10 aa, Canis lupus familiaris
GCRRAPGPRA

SEQ ID NO: 8237 - protein, 40 aa, Canis lupus familiaris
GCRSSGAWYRPRAQRCWPCVWSLCFMTWSLKRCLPRRRLN

SEQ ID NO: 8238 - protein, 9 aa, Canis lupus familiaris
GCRVGVQHG

SEQ ID NO: 8239 - protein, 77 aa, Canis lupus familiaris
GCSGRGASTAAARGAAVAGGCGTLGSPKTSLGPSRGGGSPARRTVRAPSTKSFQSGGGSEARRTGAKARFWSARAAP

SEQ ID NO: 8240 - protein, 55 aa, Canis lupus familiaris
GCSPAPPSPDRDRGRGHTAGSRPSVVGGRAAPGPRVPAPPRAARRFAGLQTGPEL

SEQ ID NO: 8241 - protein, 13 aa, Canis lupus familiaris
GCSRRIGYWAQPS

SEQ ID NO: 8242 - protein, 24 aa, Canis lupus familiaris
GCSTRRRSWPPSGWTSRTSASTWT

SEQ ID NO: 8243 - protein, 53 aa, Canis lupus familiaris
GCSWLPTPTVWSAAALWPPCPRRHPTARWPNAWLPAEYLRVTGRRPRPPQGRR

SEQ ID NO: 8244 - protein, 64 aa, Canis lupus familiaris
GCTEEGPLCPGHAGHEAVTAIWTKGARLGRWTSEQPTAELLLLWWPWGVEPENVAVPELPAVVP

SEQ ID NO: 8245 - protein, 33 aa, Canis lupus familiaris
GCTNLKITMQHNRWNHPSTMGRHYRNYAFNICQ

SEQ ID NO: 8246 - protein, 21 aa, Canis lupus familiaris
GCVGSSGCPGSRLPPSARSRT

SEQ ID NO: 8247 - protein, 21 aa, Canis lupus familiaris
GCWPRRAWSWHPSPRASWSCT

SEQ ID NO: 8248 - protein, 11 aa, Canis lupus familiaris
GCWQGRGGREG

SEQ ID NO: 8249 - protein, 21 aa, Canis lupus familiaris
GCWWPCRRVPGGGTTPWSRRW

SEQ ID NO: 8250 - protein, 34 aa, Canis lupus familiaris
GDAELQTLPGTQGAACQQGSRTPASSRSWGPSGI

SEQ ID NO: 8251 - protein, 10 aa, Canis lupus familiaris
GDGPDIEKTM

SEQ ID NO: 8252 - protein, 60 aa, Canis lupus familiaris
GDGPSAVTIRWSGHPQAPKRGRHPQPTPGPGSQHRHATPGRRLPQQPPQNPSHPGEDREP

SEQ ID NO: 8253 - protein, 26 aa, Canis lupus familiaris
GDHPGQGDHEEKEGRVVPRGGASDVP

SEQ ID NO: 8254 - protein, 50 aa, Canis lupus familiaris
GDHPGQGDHEEKEGRVVPRVGLSHPVGDGPSAQHCLQQSTSPTGGASDVP

SEQ ID NO: 8255 - protein, 19 aa, Canis lupus familiaris
GDIPRGLPGIHLFPSSWCL

SEQ ID NO: 8256 - protein, 15 aa, Canis lupus familiaris
GDPGACTAPRTACSS

SEQ ID NO: 8257 - protein, 13 aa, Canis lupus familiaris
GDQTSCGWTTPST

SEQ ID NO: 8258 - skipped

SEQ ID NO: 8259 - protein, 42 aa, Canis lupus familiaris
GDTTFQRAPLRFKLALKQACRKFVHGALAFMVGLSGGQQTSW

SEQ ID NO: 8260 - protein, 23 aa, Canis lupus familiaris
GDTTQARSPPPLLHCTCPRGTCA

SEQ ID NO: 8261 - protein, 14 aa, Canis lupus familiaris
GEAHSPSGHLALAT

SEQ ID NO: 8262 - protein, 8 aa, Canis lupus familiaris
GEAWPRLC

SEQ ID NO: 8263 - protein, 37 aa, Canis lupus familiaris
GEGAAPWARGGWLPGGTGARPGPALRPPLPPERRAGP

SEQ ID NO: 8264 - skipped

SEQ ID NO: 8265 - protein, 100 aa, Canis lupus familiaris
GEGGGGGGPPSWAARGRERASPSQRALAAAPPRAPPCGPRPSAPGAQSAAAARPGPALRREAADSASAPRRALGPHPGARRSGGAGWSASGCGGGRAAAA

SEQ ID NO: 8266 - protein, 13 aa, Canis lupus familiaris
GEGTRGTAGGPAR

SEQ ID NO: 8267 - protein, 27 aa, Canis lupus familiaris
GEGVPVAAPRAAQAWASAASGRNAFRW

SEQ ID NO: 8268 - protein, 56 aa, Canis lupus familiaris
GEIFHLLISRAEIHHSWTSGVGTYILGIFGIEKDHQWTTGVEMVLLWIIEVERHLT

SEQ ID NO: 8269 - protein, 64 aa, Canis lupus familiaris
GELGTLCCFPWPRAVTGPCPGLSRPRLRLPPCRLQSPPVRPVSCPAQKHLPGPCRSPQGWSTTR

SEQ ID NO: 8270 - protein, 43 aa, Canis lupus familiaris
GELPGWGRGAPGACAAAWPCSPPWPPCSPSRCPPRCRGETRGN

SEQ ID NO: 8271 - protein, 28 aa, Canis lupus familiaris
GELPWAVPRAAWISAPAVWSSAVMLLLT

SEQ ID NO: 8272 - protein, 25 aa, Canis lupus familiaris
GENSGGSGLALCHPQLQASPLLRPG

SEQ ID NO: 8273 - protein, 30 aa, Canis lupus familiaris
GEPEEPPPLPTPPPQAAAAAASASAPASRR

SEQ ID NO: 8274 - protein, 49 aa, Canis lupus familiaris
GEQGSGRPPGGRRSPRPLRGDSGRREGPALGAQHLRPEQQRIPGRLQWS

SEQ ID NO: 8275 - protein, 28 aa, Canis lupus familiaris
GERNSNKSRDSATKGFSSLTSHLVKDTW

SEQ ID NO: 8276 - skipped

SEQ ID NO: 8277 - protein, 44 aa, Canis lupus familiaris
GFCGARRSVGVGRQLLHEPAPGPSLAGAARPRGARAEGGCPHSP

SEQ ID NO: 8278 - protein, 89 aa, Canis lupus familiaris
GFGREVRIPGTERHLPAIHAQDRQPQLQRVGLLARRHAAFGRGRPGGQGRQEGPRRGRRRRRQQGLRGRLGRRGTRGAGARPDQLRRRD

SEQ ID NO: 8279 - protein, 24 aa, Canis lupus familiaris
GFGSDIQSRRENHQRRFFGDPLPF

SEQ ID NO: 8280 - protein, 36 aa, Canis lupus familiaris
GFGSTGSPSHTWGCTRCAPESPSSPRTPRCSPALCG

SEQ ID NO: 8281 - protein, 12 aa, Canis lupus familiaris
GFHQAHAGLGLR

SEQ ID NO: 8282 - skipped

SEQ ID NO: 8283 - protein, 23 aa, Canis lupus familiaris
GFLSIRASPSRPGSRASPTTWWP

SEQ ID NO: 8284 - protein, 10 aa, Canis lupus familiaris
GFLSPRFSCM

SEQ ID NO: 8285 - protein, 29 aa, Canis lupus familiaris
GFPLGWGRRLWWGESLRGWWKPQYFSFFC

SEQ ID NO: 8286 - protein, 65 aa, Canis lupus familiaris
GFQFQTVQCTPGWIPWPQEKLWGFHFHHPRRRKFSAQGNQRARESGGGRGNSHQRLWPQQALLPR

SEQ ID NO: 8287 - protein, 13 aa, Canis lupus familiaris
GFQWGHWGARGQL

SEQ ID NO: 8288 - protein, 45 aa, Canis lupus familiaris
GFRGRGPPASRLPGLRDAPPPAPAGPVGSLQSWGNGHSILHWPPH

SEQ ID NO: 8289 - protein, 93 aa, Canis lupus familiaris
GFRPRSPDSGYRAPPASHSRPGQAAPAPARRPARQEACCLRPGAARRARTTRRTPTWAAAAAPARAPGAPRPKGDPRGWRTAGSAAAEGLMWT

SEQ ID NO: 8290 - protein, 34 aa, Canis lupus familiaris
GFVPVWRRRPRSPSLGVAPAPPAQAPEVRQAGAL

SEQ ID NO: 8291 - protein, 16 aa, Canis lupus familiaris
GFWSPQQHLHSRHLAR

SEQ ID NO: 8292 - skipped

SEQ ID NO: 8293 - protein, 23 aa, Canis lupus familiaris
GGAALQRRGPAGAARPALGRLRG

SEQ ID NO: 8294 - protein, 33 aa, Canis lupus familiaris
GGADAAPRPPPRPRPIRAGPAEGPRAGTTRART

SEQ ID NO: 8295 - protein, 75 aa, Canis lupus familiaris
GGAGPPTFLTSALPWSLLPSRGWLQSSCAQGPCRRCWSPLPHTSRNTSLAHGARTRCRQATVSTSCPGSRTARTR

SEQ ID NO: 8296 - protein, 41 aa, Canis lupus familiaris
GGAGRRGAARGPGGRGCPLPRRPHPRRGLGWDLLGIPRLPA

SEQ ID NO: 8297 - protein, 36 aa, Canis lupus familiaris
GGAPGGPRGPARPAPEPSPLRAARGPEEGRARTDYM

SEQ ID NO: 8298 - protein, 47 aa, Canis lupus familiaris
GGARRGRGRGTRARRARRRRRRRRRRGPGARGRGLPGPLPAGVEQAA

SEQ ID NO: 8299 - protein, 74 aa, Canis lupus familiaris
GGCRGPCQACSSPPSTPHMHSYRALAPEDRVGPYVIPHLEAAELARFFYAVSPPFPLQDITRGNPRRTSWIPGC

SEQ ID NO: 8300 - protein, 40 aa, Canis lupus familiaris
GGEHCAQAQFCGHDDGGGGSVCPDRPDPRHAGGGGCRVAP

SEQ ID NO: 8301 - protein, 51 aa, Canis lupus familiaris
GGEPSSPRRPAGPALRAWAWVGPGVSRAQGALAYSLLRANLGRGPAGECGP

SEQ ID NO: 8302-8303 - skipped (2 entries)

SEQ ID NO: 8304 - protein, 32 aa, Canis lupus familiaris
GGGGAAPGEQAASAGVSVRGAPRCRRFPLRSR

SEQ ID NO: 8305 - skipped

SEQ ID NO: 8306 - protein, 14 aa, Canis lupus familiaris
GGGGEPDLSFLFAA

SEQ ID NO: 8307 - protein, 27 aa, Canis lupus familiaris
GGGGGGGDRRRGGGSAPAPADFAGGRG

SEQ ID NO: 8308 - skipped

SEQ ID NO: 8309 - protein, 29 aa, Canis lupus familiaris
GGGGGGGGGGGGRAGVADPRGGRRRAARG

SEQ ID NO: 8310 - protein, 61 aa, Canis lupus familiaris
GGGGGGRRRRRGPRLRLLPARCGARARDGGAGEHRAGVCAGRPLRGGCDPRRVLPGVLEPS

SEQ ID NO: 8311 - skipped

SEQ ID NO: 8312 - protein, 60 aa, Canis lupus familiaris
GGGHCPGLGGLSRGGSLPRGSPARLSFPPGRAHLHLLWGTRLRPMACDPRVPRLHVALGV

SEQ ID NO: 8313 - protein, 13 aa, Canis lupus familiaris
GGGPRQPQLFPPR

SEQ ID NO: 8314 - protein, 8 aa, Canis lupus familiaris
GGGRGGRP

SEQ ID NO: 8315 - protein, 21 aa, Canis lupus familiaris
GGGRPCSRMPQHPHHLHLSHA

SEQ ID NO: 8316 - protein, 43 aa, Canis lupus familiaris
GGGRRAPAAQHLVRADRGLGPQSGHGALVGTQQQRYTYPDEAV

SEQ ID NO: 8317 - protein, 17 aa, Canis lupus familiaris
GGHGKEGLQQEAMVDCI

SEQ ID NO: 8318 - protein, 24 aa, Canis lupus familiaris
GGHRRIGDQPGAPDSLEPLWDQCG

SEQ ID NO: 8319 - protein, 55 aa, Canis lupus familiaris
GGIPPSGPPAPATSHHCGGPAQPCLRQRGPQAAGGVTAGHPRPLQGSAPGGGREW

SEQ ID NO: 8320 - protein, 85 aa, Canis lupus familiaris
GGKSQTSPWAACPYGLCLCRARCGTERTSATPTPKAHRGPSWTPQGRRCRSAVGPTTSCGSRSGRGRPWSGKESTGTIPKEVPGP

SEQ ID NO: 8321 - protein, 41 aa, Canis lupus familiaris
GGLRVGHCGRRRLRRGAGVPDLRGGGGDRLWLRLHGALRWL

SEQ ID NO: 8322 - protein, 23 aa, Canis lupus familiaris
GGPGGQRWRQQRGGYETPQFGFL

SEQ ID NO: 8323 - protein, 85 aa, Canis lupus familiaris
GGPGPLDHASAAEPPGRVGPGPSGTGRLALRPSGVGRNPKRAAPVSGRPRRSEPRAHGSAAGPEMGWRRPRARARPPCCWRCRPR

SEQ ID NO: 8324 - protein, 86 aa, Canis lupus familiaris
GGPPAGLSGLGRGRLRVPLSQHLVRSPCQCHPGDCIRSLPRGDPIPAGDPALHLPIDHNPYGTHRDLEVQVFLPRPYRRCLLPSQC

SEQ ID NO: 8325 - skipped

SEQ ID NO: 8326 - protein, 20 aa, Canis lupus familiaris
GGPSTPAFAWPTRRTAICAP

SEQ ID NO: 8327 - protein, 24 aa, Canis lupus familiaris
GGQGARLVQSLSLTPPGTSPRVSP

SEQ ID NO: 8328 - protein, 28 aa, Canis lupus familiaris
GGQGTWIRLRWSWRRTRTWRTRWQRSRV

SEQ ID NO: 8329 - skipped

SEQ ID NO: 8330 - protein, 70 aa, Canis lupus familiaris
GGRAAPAGPRPWSKEALSSPLLRPGPPPPGALPRLATPASAALSESGSPRAPPAPSRTLPQGPETPVPGM

SEQ ID NO: 8331 - protein, 72 aa, Canis lupus familiaris
GGRAAPAPAGPRPWSKEALSSPLLRPGPPPPGALPRLATPASAALSESGSPRAPPAPSRTLPQGPETPVPGM

SEQ ID NO: 8332 - protein, 9 aa, Canis lupus familiaris
GGRASPCCR

SEQ ID NO: 8333 - protein, 31 aa, Canis lupus familiaris
GGRLPFRDLGAGVLLPVLLLVLLRRLLPGRR

SEQ ID NO: 8334 - protein, 21 aa, Canis lupus familiaris
GGRPGRGAQGGPHPGGERREC

SEQ ID NO: 8335 - protein, 13 aa, Canis lupus familiaris
GGRPRRGSFGLRL

SEQ ID NO: 8336 - protein, 14 aa, Canis lupus familiaris
GGRPTPGEGRQWLH

SEQ ID NO: 8337 - protein, 18 aa, Canis lupus familiaris
GGRTPPADALRSWGEGPC

SEQ ID NO: 8338 - protein, 34 aa, Canis lupus familiaris
GGRTVVFGVRTPRPLPCPPGVRVPSPLSRENLSR

SEQ ID NO: 8339 - protein, 30 aa, Canis lupus familiaris
GGRVRRSLQERRALTDLWRVRVAAGGRALA

SEQ ID NO: 8340 - skipped

SEQ ID NO: 8341 - protein, 47 aa, Canis lupus familiaris
GGSGSARLPSRRTPPCRKVMGPASPMGMRRRAQPSASTRRCSACSTS

SEQ ID NO: 8342 - protein, 41 aa, Canis lupus familiaris
GGSGSSGGGSRGCGEWAQHVRADQPGHLERLYQRQPWLLPQ

SEQ ID NO: 8343 - protein, 11 aa, Canis lupus familiaris
GGSRRTCFALA

SEQ ID NO: 8344 - skipped

SEQ ID NO: 8345 - protein, 81 aa, Canis lupus familiaris
GHAAGAAQCHPAAWLPGTESAAVHGGTRLHPLPGARGAAGQLLPGPDAPGRARPLSRRGRVLPRVGALLLLGVGHRRRLGE

SEQ ID NO: 8346 - protein, 11 aa, Canis lupus familiaris
GHADLREDLDG

SEQ ID NO: 8347 - protein, 14 aa, Canis lupus familiaris
GHAPQLLHLHLWQW

SEQ ID NO: 8348 - protein, 18 aa, Canis lupus familiaris
GHCWCCCFLLGGPWPSSC

SEQ ID NO: 8349 - protein, 35 aa, Canis lupus familiaris
GHGAPLHKPQGHLLQGHPVCCQLRKRRFGHLLHHI

SEQ ID NO: 8350 - protein, 14 aa, Canis lupus familiaris
GHGLCLYATARTSA

SEQ ID NO: 8351 - protein, 33 aa, Canis lupus familiaris
GHGSRLQHRSPAPGLLRGRPAFAAPHRLPHQNL

SEQ ID NO: 8352 - protein, 17 aa, Canis lupus familiaris
GHHLRGSRKGPEPGSSP

SEQ ID NO: 8353 - protein, 36 aa, Canis lupus familiaris
GHHPCPALPREWGLPLPAHQCCGGLLHPHTRAAVHG

SEQ ID NO: 8354 - protein, 11 aa, Canis lupus familiaris
GHHRLALPLPL

SEQ ID NO: 8355 - protein, 51 aa, Canis lupus familiaris
GHLAPTPLLLAGKHPKKRQFPEASTAKDLSPSSRAPRPGGVNTAVRHHRGR

SEQ ID NO: 8356 - protein, 53 aa, Canis lupus familiaris
GHLAPTPLLLAGKHPKKRQFPEASTAKDLSPSSRHRAPRPGGVNTAVRHHRGR

SEQ ID NO: 8357 - protein, 35 aa, Canis lupus familiaris
GHLHQRFCDYPHVLPLPVLHAHRKICAQPQCLHQQ

SEQ ID NO: 8358 - skipped

SEQ ID NO: 8359 - protein, 30 aa, Canis lupus familiaris
GHPLHPGPCRGQPWGPLLCHTAVPAAGRLS

SEQ ID NO: 8360 - protein, 55 aa, Canis lupus familiaris
GHQLPSAALPLPLTMSSTCGPDQTVLKQNLRMGTGLGSTSVSGEELQGNSSRSTL

SEQ ID NO: 8361 - protein, 46 aa, Canis lupus familiaris
GHQQGQHIPGLLSPPHASPPGCKTGPSGLHPSLQPPEKPPGRQGFL

SEQ ID NO: 8362 - protein, 14 aa, Canis lupus familiaris
GHQVDIRSLSPDQL

SEQ ID NO: 8363 - protein, 39 aa, Canis lupus familiaris
GHRAPRRPQRPPQGARGAGAGAGAGERARPPPRPRGRGG

SEQ ID NO: 8364 - protein, 19 aa, Canis lupus familiaris
GHRARETRCGVSSPRESNS

SEQ ID NO: 8365 - protein, 30 aa, Canis lupus familiaris
GHRHHSHHGRGHCWCLLWDGAGARELAAKL

SEQ ID NO: 8366 - protein, 8 aa, Canis lupus familiaris
GHRIRNVQ

SEQ ID NO: 8367 - skipped

SEQ ID NO: 8368 - protein, 29 aa, Canis lupus familiaris
GHSQHPARWERGHSLDQSQEKWMKPTLCF

SEQ ID NO: 8369 - protein, 89 aa, Canis lupus familiaris
GHVRLPGDGGGGVRQRRAHLPQPVRAARPEPRGASPGRAPGRAGAEGRLRGARGLECRPAPEPVQLPRGGGGEGGALRGAPAAVPQVTS

SEQ ID NO: 8370 - protein, 26 aa, Canis lupus familiaris
GHWETGMRCTGTAPTSTCDERATRCR

SEQ ID NO: 8371 - protein, 16 aa, Canis lupus familiaris
GHWPASMPVGGLLRGL

SEQ ID NO: 8372 - protein, 60 aa, Canis lupus familiaris
GHWRHKRGSLRTRAQQVALRPLQAPPRLCGGRAAPPRKCPLRPPGFCLLAARPADVQEHE

SEQ ID NO: 8373 - protein, 55 aa, Canis lupus familiaris
GIGTETGTEIGTGTGHPRRLGLPRSQRPPRGPRQSHRSAAAQALRRPHAPLPPGR

SEQ ID NO: 8374 - protein, 15 aa, Canis lupus familiaris
GIHQAAALHIRYGKG

SEQ ID NO: 8375 - protein, 36 aa, Canis lupus familiaris
GIMGPQYLCSKRRRRGAVNRSSGCTGRTTSSPRWAP

SEQ ID NO: 8376 - protein, 9 aa, Canis lupus familiaris
GIMLFTQLP

SEQ ID NO: 8377 - protein, 12 aa, Canis lupus familiaris
GISSHQQHCLFP

SEQ ID NO: 8378 - protein, 17 aa, Canis lupus familiaris
GKARPGWPWPQTSVIFA

SEQ ID NO: 8379 - protein, 17 aa, Canis lupus familiaris
GKARPGWPWPQTSVTSA

SEQ ID NO: 8380 - protein, 24 aa, Canis lupus familiaris
GKATAPSAACAGEPASLPSCCSCW

SEQ ID NO: 8381 - protein, 45 aa, Canis lupus familiaris
GKERSWGRKRRWKRRVMLMTVMKRRRKRRKRAPLRGWRPRTGPRG

SEQ ID NO: 8382 - protein, 14 aa, Canis lupus familiaris
GKESLGRERGMERM

SEQ ID NO: 8383 - protein, 10 aa, Canis lupus familiaris
GKGLLVRKNS

SEQ ID NO: 8384 - protein, 9 aa, Canis lupus familiaris
GKGPRSTSR

SEQ ID NO: 8385 - protein, 13 aa, Canis lupus familiaris
GKGQQWGHRERWQ

SEQ ID NO: 8386 - skipped

SEQ ID NO: 8387 - protein, 20 aa, Canis lupus familiaris
GKQVTGMVWGVLGELGQGVR

SEQ ID NO: 8388 - protein, 53 aa, Canis lupus familiaris
GKRLCPGWHHPGPGRVWHPCGHGRRDIYWGLHGCPVLRGAELQPDPDPGQGVG

SEQ ID NO: 8389 - protein, 39 aa, Canis lupus familiaris
GKRQSAAARPRSGRQARAGGVAGCWGPGSAGSPDTPSQH

SEQ ID NO: 8390 - protein, 19 aa, Canis lupus familiaris
GKRSPSPARFLDVKRDTRM

SEQ ID NO: 8391 - protein, 36 aa, Canis lupus familiaris
GKRSSSSGWASGRIACCRSRPRGWCSAAWPPRHGWC

SEQ ID NO: 8392 - protein, 57 aa, Canis lupus familiaris
GKSESPHPAMPVFLPSAGSGSPGIGSSTWAPCSAWAQAGRVPTPQHPWACTSVTGRH

SEQ ID NO: 8393 - protein, 21 aa, Canis lupus familiaris
GLAAAPGEGCAGARGGPRGCA

SEQ ID NO: 8394 - protein, 84 aa, Canis lupus familiaris
GLAGRYYSGLSMADTTTNSPMQGSQRAWAGRMAAPEAELPSWVAPAGLGPCCCVGCHQGFYRCPPRQGGRRPAPSLTSASLPWP

SEQ ID NO: 8395 - protein, 30 aa, Canis lupus familiaris
GLALGCLGGLGQLLGTGKRGLELRRARNGS

SEQ ID NO: 8396 - protein, 24 aa, Canis lupus familiaris
GLAPFFSLVDGRRTPGQRPEQAAG

SEQ ID NO: 8397 - protein, 26 aa, Canis lupus familiaris
GLAPGAATPAREATTSAAATAWPLWG

SEQ ID NO: 8398 - skipped

SEQ ID NO: 8399 - protein, 20 aa, Canis lupus familiaris
GLCGCKKVYRTPSTRGAQGN

SEQ ID NO: 8400 - protein, 22 aa, Canis lupus familiaris
GLCHPAEEHRGTACGDGPHVLR

SEQ ID NO: 8401 - protein, 21 aa, Canis lupus familiaris
GLCIVARRGSPPFPPTDSPGR

SEQ ID NO: 8402 - protein, 38 aa, Canis lupus familiaris
GLCLLARCGGAGDHQGADGHREENWRLCATDALPLLRR

SEQ ID NO: 8403 - protein, 22 aa, Canis lupus familiaris
GLECGSYGEGMFVVSSLPIMAG

SEQ ID NO: 8404 - protein, 56 aa, Canis lupus familiaris
GLGAPLRGLHVPPREVLGLSGKETGLRAARLASGSAAHAAGQEQDPHIEGQDVFQV

SEQ ID NO: 8405 - protein, 45 aa, Canis lupus familiaris
GLGDLSLFTPVVPSSFRIPKLQILGSTNAQQGTHLVAIMQQLTFR

SEQ ID NO: 8406 - protein, 41 aa, Canis lupus familiaris
GLGGSPDSECAAGAGAGAGAGARAAGSQRSADSAGAAGALP

SEQ ID NO: 8407 - protein, 94 aa, Canis lupus familiaris
GLGGSRSVGPGEGGAHPQVHCPSVTHPAQPAAPEGPGPHLPHRGLPCVPAAGGRTAGIREVAAGPWGGAHRDCLGSEVACPRLPPEQPADPGPH

SEQ ID NO: 8408 - protein, 41 aa, Canis lupus familiaris
GLGLWDDVPTTPHQPLQDCGAPGPLQPSSHICGECRGTKGP

SEQ ID NO: 8409 - protein, 39 aa, Canis lupus familiaris
GLGPVSPTRFTSTLMLVTTGRVLGRMPGAARLPESQGRC

SEQ ID NO: 8410 - protein, 37 aa, Canis lupus familiaris
GLGPVSPTRFTSTLMLVTTGRVLGRMPGAARLPESQS

SEQ ID NO: 8411 - protein, 13 aa, Canis lupus familiaris
GLGRAGRPLCRKP

SEQ ID NO: 8412 - protein, 17 aa, Canis lupus familiaris
GLGRLFPCPLRGSLGAV

SEQ ID NO: 8413 - protein, 26 aa, Canis lupus familiaris
GLGRRPLGQVVVTLLPVMRANRMGRL

SEQ ID NO: 8414 - protein, 38 aa, Canis lupus familiaris
GLGVSASPFPSAHQGVCLLEGLGDLEKAIPSRVQVGRK

SEQ ID NO: 8415 - protein, 87 aa, Canis lupus familiaris
GLHACPASSENHWSPEQLLGDSGGIKQHALPAPAHGSGCQGLSEGRTPHGPAAVPLPAPGLRLPTSEGHRSLLLPQAREEEDPVPLQ

SEQ ID NO: 8416 - protein, 19 aa, Canis lupus familiaris
GLHCPVHQDSQGTKARRIQ

SEQ ID NO: 8417 - protein, 17 aa, Canis lupus familiaris
GLHFLVRAPLRDPVFTQ

SEQ ID NO: 8418 - protein, 43 aa, Canis lupus familiaris
GLHLHPCRTSQPSSLGRIPSSASGLALGHLSRAIPSSPGRRRC

SEQ ID NO: 8419 - protein, 8 aa, Canis lupus familiaris
GLHPHGLR

SEQ ID NO: 8420 - protein, 10 aa, Canis lupus familiaris
GLHPHGLRLP

SEQ ID NO: 8421 - protein, 14 aa, Canis lupus familiaris
GLHPLTGDSQSCLR

SEQ ID NO: 8422 - protein, 24 aa, Canis lupus familiaris
GLHREHRLQQALGLRGPQRVHPDC

SEQ ID NO: 8423 - protein, 17 aa, Canis lupus familiaris
GLKSHMSGLCVSCSGTT

SEQ ID NO: 8424 - protein, 80 aa, Canis lupus familiaris
GLKSYPREKLSSLGAESLGSSPGTSHLPPNLWGSAAWEEQEVFLGSIGKQTVQAHRPLPEEIWAQEDTGVGASGGDRRRQ

SEQ ID NO: 8425 - protein, 9 aa, Canis lupus familiaris
GLLATRKCT

SEQ ID NO: 8426 - protein, 62 aa, Canis lupus familiaris
GLLEELGAGEEGSRGCGRGGLPERRPGTRSHSPGGGAAVDWVEWGVPPGEREAGGRRRWPLQ

SEQ ID NO: 8427 - protein, 36 aa, Canis lupus familiaris
GLLGGRGLLHQPLVHRNVCRQGEQGKYSGARGHSGD

SEQ ID NO: 8428 - protein, 8 aa, Canis lupus familiaris
GLLPGVTC

SEQ ID NO: 8429 - protein, 32 aa, Canis lupus familiaris
GLLQGAEAFQGSVHAGGAHAQAYGREAAQVYV

SEQ ID NO: 8430 - protein, 35 aa, Canis lupus familiaris
GLLRHSPASDGKIGPPLPKGLRAQRERLRHQVESF

SEQ ID NO: 8431 - protein, 9 aa, Canis lupus familiaris
GLMGLKVLM

SEQ ID NO: 8432 - protein, 29 aa, Canis lupus familiaris
GLMVERSRPSGNMEQGEGLSGEIFWKMQE

SEQ ID NO: 8433 - protein, 58 aa, Canis lupus familiaris
GLPAAGIRVHGSRLEPWTPLEDPGLCPEPAAPPAQDLGPVHASRLRDVGLRKAFWVHN

SEQ ID NO: 8434 - protein, 18 aa, Canis lupus familiaris
GLPAPRQAAEDELDRRPR

SEQ ID NO: 8435 - protein, 9 aa, Canis lupus familiaris
GLPARLWTQ

SEQ ID NO: 8436 - protein, 29 aa, Canis lupus familiaris
GLPAVGPARPRPAPGAHPSPGPAAAAAAQ

SEQ ID NO: 8437 - protein, 12 aa, Canis lupus familiaris
GLPHLPEGRKSN

SEQ ID NO: 8438 - protein, 14 aa, Canis lupus familiaris
GLPHSSRPSRQLLH

SEQ ID NO: 8439 - skipped

SEQ ID NO: 8440 - protein, 64 aa, Canis lupus familiaris
GLPIPDSPVYPRLDPMATGEALGVSFSPSPKKEVLSTREPKSKRIRRRKRKFPPKTLATTGSPT

SEQ ID NO: 8441 - protein, 27 aa, Canis lupus familiaris
GLPLGGPAMVLLEASSVHLDLLRGQLL

SEQ ID NO: 8442 - protein, 49 aa, Canis lupus familiaris
GLPLGSCCWRQMSCAMTAGTRGVLWFLGLGSGGPPTHPPASCHRNTGYM

SEQ ID NO: 8443 - protein, 23 aa, Canis lupus familiaris
GLPLRNPLRKGTQQRSMWSEMKN

SEQ ID NO: 8444 - protein, 26 aa, Canis lupus familiaris
GLPPASSCVSTLTWPKSPSPEACPPA

SEQ ID NO: 8445 - protein, 9 aa, Canis lupus familiaris
GLPPGPGRL

SEQ ID NO: 8446 - skipped

SEQ ID NO: 8447 - protein, 54 aa, Canis lupus familiaris
GLPQPAQRKLLRSQQSRPHREQQQQPLLGLPQRRLREQRSLRHRLHRKPTGVLF

SEQ ID NO: 8448 - protein, 15 aa, Canis lupus familiaris
GLPQTRSSSVHARSA

SEQ ID NO: 8449 - protein, 56 aa, Canis lupus familiaris
GLPQVSCPPWAFRAWSCRLPRWARFPCSTLPPCPGRSPLPPARSQTRSSSVHARSA

SEQ ID NO: 8450 - skipped

SEQ ID NO: 8451 - protein, 19 aa, Canis lupus familiaris
GLPRAQKKASRAHPGRFWP

SEQ ID NO: 8452 - protein, 12 aa, Canis lupus familiaris
GLPSAPTPSTSL

SEQ ID NO: 8453 - protein, 30 aa, Canis lupus familiaris
GLPSGPGLAPPPRRATRAVCSLKPAGRGAS

SEQ ID NO: 8454 - protein, 27 aa, Canis lupus familiaris
GLPSSVGPCRLASSLWQWMERAWSSYH

SEQ ID NO: 8455 - protein, 12 aa, Canis lupus familiaris
GLPSSVGPCSYH

SEQ ID NO: 8456 - protein, 35 aa, Canis lupus familiaris
GLPVSPPSLHPPWRLLQGDPREPPEPPPEASQWPL

SEQ ID NO: 8457 - protein, 53 aa, Canis lupus familiaris
GLQAGSGGLWHPQAADPVRGGGRQGGDRPAGGGDHQVRGARAECGHCCFQQDL

SEQ ID NO: 8458 - protein, 57 aa, Canis lupus familiaris
GLQGGGAARINTKLPRSRASGWLGTGGFRGLGGDLQARGQMWGSQEGPWWLLAHQEG

SEQ ID NO: 8459 - protein, 35 aa, Canis lupus familiaris
GLQGLLVAPRPALRTQPQRPRSPGLRVLGTQAWCY

SEQ ID NO: 8460 - protein, 59 aa, Canis lupus familiaris
GLQIMATLWRMVPPGSGLEVQPRVRRVRRAHPWPGWRPVPRSRGASEPSRASRRTSSSS

SEQ ID NO: 8461 - protein, 11 aa, Canis lupus familiaris
GLQPRAPEPRS

SEQ ID NO: 8462 - protein, 27 aa, Canis lupus familiaris
GLQREVPKKRLWRETPQRKRKKWMKRL

SEQ ID NO: 8463-8464 - skipped (2 entries)

SEQ ID NO: 8465 - protein, 9 aa, Canis lupus familiaris
GLRLRQKDE

SEQ ID NO: 8466 - protein, 23 aa, Canis lupus familiaris
GLRPGGRLWRRLQQQQQLWWGPG

SEQ ID NO: 8467 - protein, 23 aa, Canis lupus familiaris
GLRPGGRLWRWLQQQQQLWWGPG

SEQ ID NO: 8468 - protein, 62 aa, Canis lupus familiaris
GLRRAGGRVAGVPGPPARAPSACRSDTKGDGWRGAHRARSPGRPQARPPPPQRRGGRGTRGT

SEQ ID NO: 8469 - protein, 49 aa, Canis lupus familiaris
GLRRRGPARRADVPGRGLPGAPGLPRPRALGRAAQPSALPPAPGAPPPL

SEQ ID NO: 8470 - protein, 38 aa, Canis lupus familiaris
GLRSSTRAGSHCMKSQAMAPTRSSSTSSPPTMLASTGV

SEQ ID NO: 8471 - protein, 13 aa, Canis lupus familiaris
GLRTPPLDWGRSL

SEQ ID NO: 8472 - protein, 10 aa, Canis lupus familiaris
GLSCWRRPNC

SEQ ID NO: 8473 - protein, 78 aa, Canis lupus familiaris
GLSGMHPALGEGGRPAVPNLGAEEPPHWCFLLPLWLLPHPPAIPGPRGGLQPPGVPAQVHPPRLLQDGVRRRVPGGEG

SEQ ID NO: 8474 - protein, 33 aa, Canis lupus familiaris
GLSMQQYSFSSCINYPSVASMLLITLCVICFPC

SEQ ID NO: 8475 - protein, 38 aa, Canis lupus familiaris
GLSPALLPAQPPRAPQAPSPGPGTLPPPWGAALSFHHC

SEQ ID NO: 8476 - protein, 72 aa, Canis lupus familiaris
GLSPMTRAQMACPSLGTAGLGPWCGGCSRGRGLPGWSRESHGQRLLAWRGQAWKVRSSREPCPGARCPRSPS

SEQ ID NO: 8477 - protein, 23 aa, Canis lupus familiaris
GLSRFLLPGGACTHAPSWPQLQR

SEQ ID NO: 8478 - protein, 62 aa, Canis lupus familiaris
GLSYGKASSGGGGIKRALTLGSSGFGSSKHPVGDSCPLQRRTSCAPVPPEPHGRRGSSEQRW

SEQ ID NO: 8479 - protein, 10 aa, Canis lupus familiaris
GLTDSLSPRS

SEQ ID NO: 8480 - protein, 13 aa, Canis lupus familiaris
GLTRCPWPTSLSY

SEQ ID NO: 8481 - protein, 19 aa, Canis lupus familiaris
GLTSTAPFSRNSSAVRASS

SEQ ID NO: 8482 - protein, 34 aa, Canis lupus familiaris
GLTVPLQPGQRWCDLLRRYCYTVSSVLWPLLCNL

SEQ ID NO: 8483 - protein, 87 aa, Canis lupus familiaris
GLVHLVPKVRVVTQVLRALVVFKVHLVQRENLEKGVVQVLMEEEECQENLEQREIGDLMDFQVCQVTKVTGANGAPKAPLVLLEKME

SEQ ID NO: 8484 - protein, 14 aa, Canis lupus familiaris
GLVLPPGAEIQKVT

SEQ ID NO: 8485 - protein, 82 aa, Canis lupus familiaris
GLVVVLGVASVEGLVVVLAEASEVALEVALVGVMAAALVTTVVAMVASSLAMRRSPCRTSTTAWPPTWTRCTPWRRPTATWR

SEQ ID NO: 8486 - protein, 11 aa, Canis lupus familiaris
GLWEQTKRQNS

SEQ ID NO: 8487-8488 - skipped (2 entries)

SEQ ID NO: 8489 - protein, 14 aa, Canis lupus familiaris
GLYVPVRTVIPEGL

SEQ ID NO: 8490 - skipped

SEQ ID NO: 8491 - protein, 9 aa, Canis lupus familiaris
GMGFLMSIM

SEQ ID NO: 8492 - protein, 19 aa, Canis lupus familiaris
GMLFFPALETETQPPLSPG

SEQ ID NO: 8493 - protein, 16 aa, Canis lupus familiaris
GMPWMSRASRRTLRRS

SEQ ID NO: 8494 - protein, 39 aa, Canis lupus familiaris
GMRSSCSVTRCRKRTLKCISRDQAGRPEAPFLKLMYTDK

SEQ ID NO: 8495 - skipped

SEQ ID NO: 8496 - protein, 52 aa, Canis lupus familiaris
GMVTALSAAQAWGGRPRTPPLRPPRRRERGPAAQPRAASSRSPARWACLSPR

SEQ ID NO: 8497 - skipped

SEQ ID NO: 8498 - protein, 50 aa, Canis lupus familiaris
GMYPGTSLCALGLHMMSQTPASPTRLSTGLGSRPLFLAGTMCSLSGCLTV

SEQ ID NO: 8499 - protein, 9 aa, Canis lupus familiaris
GNCRSRRWT

SEQ ID NO: 8500 - protein, 21 aa, Canis lupus familiaris
GNDCLANRHLLSRNGDEAYCY

SEQ ID NO: 8501 - protein, 22 aa, Canis lupus familiaris
GNPRPLHPLHPLPSNPEVSLNR

SEQ ID NO: 8502 - protein, 27 aa, Canis lupus familiaris
GNRFRLCITILLGMKMSWSSEKVMSLM

SEQ ID NO: 8503 - skipped

SEQ ID NO: 8504 - protein, 61 aa, Canis lupus familiaris
GNRSPRPSLSHSHVLIPRPTSWGLLLRGARRRGDSSRDSWARKNIGDAPPRRSGIGNRTTS

SEQ ID NO: 8505 - protein, 66 aa, Canis lupus familiaris
GPAASSSTTASPRPCGTASSSLPPSTLRSPSPTMSASWAMMIPPSLRDTPLSATSPWRCSSSWISS

SEQ ID NO: 8506-8507 - skipped (2 entries)

SEQ ID NO: 8508 - protein, 54 aa, Canis lupus familiaris
GPAGPHPFPLSTEPGLSTYCRLPQTPGGCPVGVTGPHSGGSCPPPTCPSTLPMW

SEQ ID NO: 8509 - protein, 12 aa, Canis lupus familiaris
GPAGSGLDTQTD

SEQ ID NO: 8510 - protein, 12 aa, Canis lupus familiaris
GPAGSQGQMEQL

SEQ ID NO: 8511 - protein, 14 aa, Canis lupus familiaris
GPALPQLPHPRALL

SEQ ID NO: 8512 - protein, 39 aa, Canis lupus familiaris
GPALRGPRRPLPPRALCPRPLPRAPRRPLRVPLLARLRL

SEQ ID NO: 8513 - protein, 22 aa, Canis lupus familiaris
GPALWWPVAATQPKRLSGRWQC

SEQ ID NO: 8514 - protein, 30 aa, Canis lupus familiaris
GPARAGRGGSAGPCRGPPALCPAGPWTSLT

SEQ ID NO: 8515 - protein, 11 aa, Canis lupus familiaris
GPARGAAPESV

SEQ ID NO: 8516 - protein, 21 aa, Canis lupus familiaris
GPARTFCPPRTGPAPSSPSAA

SEQ ID NO: 8517 - protein, 17 aa, Canis lupus familiaris
GPARTPSPPPNWTQVEA

SEQ ID NO: 8518 - skipped

SEQ ID NO: 8519 - protein, 46 aa, Canis lupus familiaris
GPASGRRSWCLASFPGSSAKCCAGQMWTSRGCWFRRTQRASSALSH

SEQ ID NO: 8520 - protein, 19 aa, Canis lupus familiaris
GPASLIPHNAPGSPGRSPC

SEQ ID NO: 8521 - protein, 50 aa, Canis lupus familiaris
GPASPASSSATSAARASLGGRRSPSTSASTRASGPIRAPSAAAASARSPT

SEQ ID NO: 8522 - protein, 20 aa, Canis lupus familiaris
GPASQSEVPGGLRDSCQRLL

SEQ ID NO: 8523 - protein, 48 aa, Canis lupus familiaris
GPASRAWTAVTAPRAGLGSSAMRLVLQTPSGRTAASPAAVRTVGPATL

SEQ ID NO: 8524 - protein, 15 aa, Canis lupus familiaris
GPATSHRCTSPSLLL

SEQ ID NO: 8525 - skipped

SEQ ID NO: 8526 - protein, 16 aa, Canis lupus familiaris
GPAVSRRPLRLRPGRL

SEQ ID NO: 8527 - protein, 22 aa, Canis lupus familiaris
GPCCSQPCVLLPRGPRRRRRRP

SEQ ID NO: 8528 - protein, 17 aa, Canis lupus familiaris
GPCGGELCARPSLRSVQ

SEQ ID NO: 8529 - protein, 31 aa, Canis lupus familiaris
GPCPRSCHPGEGSHHLCCRHCLAPLGVTGKP

SEQ ID NO: 8530 - protein, 17 aa, Canis lupus familiaris
GPCPSSWRRTTTTSTPW

SEQ ID NO: 8531 - skipped

SEQ ID NO: 8532 - protein, 27 aa, Canis lupus familiaris
GPCRQQTATTTTTGTTMRTAPPPPAAA

SEQ ID NO: 8533 - protein, 27 aa, Canis lupus familiaris
GPCTPGAPARAPAGSGCEPPPRLCARH

SEQ ID NO: 8534 - protein, 20 aa, Canis lupus familiaris
GPCVAARGKGPCRACALWGL

SEQ ID NO: 8535 - protein, 9 aa, Canis lupus familiaris
GPDGRLSEN

SEQ ID NO: 8536 - protein, 62 aa, Canis lupus familiaris
GPDLPAGRQETGPGRLGERPEGHGVCAALGKECEPVVARIAHSGLRPRRPPFVRLPGDALSE

SEQ ID NO: 8537 - protein, 49 aa, Canis lupus familiaris
GPEDEGIPCSPQRSPRPSGPGAAEKTALTPRVPRWNMPTAITAWTPGFL

SEQ ID NO: 8538 - protein, 11 aa, Canis lupus familiaris
GPEDPSEEPAP

SEQ ID NO: 8539 - skipped

SEQ ID NO: 8540 - protein, 48 aa, Canis lupus familiaris
GPELRAAPGPWRAAICTRSSSWCSTTPSWCSYASRCLWCGVKAREISF

SEQ ID NO: 8541 - protein, 42 aa, Canis lupus familiaris
GPEPLEPMTSQAGPTTSCGGRRPRSSRRPTSLWAIGATPTCS

SEQ ID NO: 8542 - protein, 44 aa, Canis lupus familiaris
GPEQGKTERSHKDSVGQWDRPGGSWGQQWARWSWGPGVSRRESF

SEQ ID NO: 8543 - protein, 13 aa, Canis lupus familiaris
GPERCGGDPGARA

SEQ ID NO: 8544 - protein, 98 aa, Canis lupus familiaris
GPGARLPAPPGRSALRRRRALVPEPPPRPQPVRGAGARDRPHARAGALPRAARAHGALLQEAGPRRAAQLGRRAGRAGPVWKAPGGLSSHPAPRKAVH

SEQ ID NO: 8545 - protein, 54 aa, Canis lupus familiaris
GPGCGSAPLTCCSSGSWCVTWTRPASRLQTPVCWRTCSAAAGSLPPSKPPSTRC

SEQ ID NO: 8546 - protein, 48 aa, Canis lupus familiaris
GPGCLTGTAMPTALGAAVEALEAVAMRRPVGQGQAVAGPAQMPSVETS

SEQ ID NO: 8547 - protein, 11 aa, Canis lupus familiaris
GPGGGDRAHWL

SEQ ID NO: 8548-8549 - skipped (2 entries)

SEQ ID NO: 8550 - protein, 9 aa, Canis lupus familiaris
GPGISPHPS

SEQ ID NO: 8551 - protein, 21 aa, Canis lupus familiaris
GPGKGSSPASSPTTRGASGCS

SEQ ID NO: 8552 - protein, 60 aa, Canis lupus familiaris
GPGPGATRAARGQPPPEPQRPRARPGARARRLLTINSTHPIQVKFIPTLNAVKRRQKTPK

SEQ ID NO: 8553 - protein, 40 aa, Canis lupus familiaris
GPGPGWGWGGRRWLWRGDGGARPGLLRPLRHVLAASILQR

SEQ ID NO: 8554 - protein, 27 aa, Canis lupus familiaris
GPGPHANLGILLYLGPFCPTCPEDQLP

SEQ ID NO: 8555 - skipped

SEQ ID NO: 8556 - protein, 49 aa, Canis lupus familiaris
GPGRGAGRRRWRRRRRRRPPLQPGARAPSHGPLQPGGHQRREPLGRLRG

SEQ ID NO: 8557 - protein, 20 aa, Canis lupus familiaris
GPGRRGAAAALGSPLRGAGQ

SEQ ID NO: 8558 - protein, 58 aa, Canis lupus familiaris
GPGRWPSASSKGCAAQILAPPPPRMAADCRPRSDGEKERAAIPMDAVPGRGKRKRLQV

SEQ ID NO: 8559 - protein, 16 aa, Canis lupus familiaris
GPGSRPSCPPLALAHR

SEQ ID NO: 8560 - protein, 43 aa, Canis lupus familiaris
GPGSRRGHPGRLGSWRLPPPFPPASANSDSGSGKHPKRKLISP

SEQ ID NO: 8561 - protein, 16 aa, Canis lupus familiaris
GPGTGPPGSSWATAAL

SEQ ID NO: 8562-8563 - skipped (2 entries)

SEQ ID NO: 8564 - protein, 38 aa, Canis lupus familiaris
GPGWGPAAAAPPLREGGFWLRGRRPRPDGREGEGKPVR

SEQ ID NO: 8565 - protein, 25 aa, Canis lupus familiaris
GPHHHGFLQQVPQQLLPGQHYHQHH

SEQ ID NO: 8566 - protein, 15 aa, Canis lupus familiaris
GPHHHRLLRHQLRRV

SEQ ID NO: 8567 - protein, 69 aa, Canis lupus familiaris
GPHPHPPRTQHASWPWPWLSGLSRWPRDRANRSMGAPLLLPTPLSTAHCHWRWAVSPQGPQGLGQPPIP

SEQ ID NO: 8568 - protein, 14 aa, Canis lupus familiaris
GPHQRIHDDCYCWN

SEQ ID NO: 8569 - protein, 27 aa, Canis lupus familiaris
GPHRGGRRGDRQWHGTADLCAPHGGGD

SEQ ID NO: 8570 - protein, 20 aa, Canis lupus familiaris
GPHRQPHLTCQDECRAGQGH

SEQ ID NO: 8571 - protein, 53 aa, Canis lupus familiaris
GPISSGPPCSPTPRPPSPALPALWPLTPWGGPTRHPTLPALLPCYSPPGSSSP

SEQ ID NO: 8572 - protein, 12 aa, Canis lupus familiaris
GPITQLPRLSSG

SEQ ID NO: 8573 - protein, 37 aa, Canis lupus familiaris
GPLCCHCEKLPGDGADYLPGCGSHRGLDSDRDLAVLA

SEQ ID NO: 8574 - protein, 10 aa, Canis lupus familiaris
GPLGACWARG

SEQ ID NO: 8575 - protein, 51 aa, Canis lupus familiaris
GPLGGLRVPGETERLQLTVPGPAGGLHREKLVHSVQPELELEPEPKPLGGT

SEQ ID NO: 8576-8577 - skipped (2 entries)

SEQ ID NO: 8578 - protein, 44 aa, Canis lupus familiaris
GPLLQPGPELLHPPQALQEWGHLYQHRAGKLHLLLPARVLGGQL

SEQ ID NO: 8579 - protein, 77 aa, Canis lupus familiaris
GPLPRPAAGPPAPRQDSGRSSQSPLPRPSPEGGGAGGDPGGLPQPQRNRKTWEEQNLEPRRRDCPGRRGPGRAGDAA

SEQ ID NO: 8580 - protein, 19 aa, Canis lupus familiaris
GPLQPGYGAVPVPSRENWG

SEQ ID NO: 8581 - protein, 18 aa, Canis lupus familiaris
GPLQVASQLWARQPGFWG

SEQ ID NO: 8582 - protein, 87 aa, Canis lupus familiaris
GPLRAPTSLSAPGLDCTPRLPDFSPLQYQPGIPLVPRGPPTDLWTSRPRQEAATRFFRPLLLKFTASVVVSDSTPVPGSTPTRRGAF

SEQ ID NO: 8583 - protein, 25 aa, Canis lupus familiaris
GPLRRTGAVPAAPGPVRAAHSHPQA

SEQ ID NO: 8584 - protein, 9 aa, Canis lupus familiaris
GPLTPRDCQ

SEQ ID NO: 8585 - protein, 15 aa, Canis lupus familiaris
GPLVTGSSSTSDPAQ

SEQ ID NO: 8586 - protein, 47 aa, Canis lupus familiaris
GPMPATGRCSPAGGPGASSSEHSTPRWLPLPAVPGQWEPTSLLLLVS

SEQ ID NO: 8587 - protein, 32 aa, Canis lupus familiaris
GPMWYPHTQPTLPREPHRASWSMPTREQKKIS

SEQ ID NO: 8588 - skipped

SEQ ID NO: 8589 - protein, 46 aa, Canis lupus familiaris
GPPGAADRGQPAGVRTGRAGSRLPGAPQGLPGDPQLAAAAALPAGL

SEQ ID NO: 8590 - protein, 17 aa, Canis lupus familiaris
GPPGGVGCWGGGKQGLR

SEQ ID NO: 8591 - protein, 16 aa, Canis lupus familiaris
GPPMPGPRGAPGRREA

SEQ ID NO: 8592 - protein, 26 aa, Canis lupus familiaris
GPPNSIQPAVRKMCLMDICWGPQIAK

SEQ ID NO: 8593 - protein, 13 aa, Canis lupus familiaris
GPPQLSLKSFRLL

SEQ ID NO: 8594 - protein, 72 aa, Canis lupus familiaris
GPPRASETPAAAPRSARRWRRSRCGGTRAPSAEASRPWRLITSGSSPTGGPGEASRSWTTRPGTRGSTWWTS

SEQ ID NO: 8595 - protein, 11 aa, Canis lupus familiaris
GPPRLSPPALP

SEQ ID NO: 8596 - protein, 14 aa, Canis lupus familiaris
GPPSGHSKPVARST

SEQ ID NO: 8597 - protein, 9 aa, Canis lupus familiaris
GPPSMPCTS

SEQ ID NO: 8598 - protein, 8 aa, Canis lupus familiaris
GPPSPTLL

SEQ ID NO: 8599 - protein, 24 aa, Canis lupus familiaris
GPQGGPVGRELRLPGAGKPPSARP

SEQ ID NO: 8600 - protein, 75 aa, Canis lupus familiaris
GPQKLPKGEAFLPGGRESRQLPWNQPPSPQSLGFRCLGGTRGIPWFHREANSPSTPAAPGRNLGPGGHGSRSQWW

SEQ ID NO: 8601 - protein, 34 aa, Canis lupus familiaris
GPQLCQSWISAPGLWFCSPPWAGNPTPQLRFHAG

SEQ ID NO: 8602 - protein, 48 aa, Canis lupus familiaris
GPQSSPRRPPSSGRSGWPRSGKRTCGSGGGCGRPTPSRSWCRSPAGRC

SEQ ID NO: 8603 - protein, 21 aa, Canis lupus familiaris
GPQVRRCCPTCSVISPRRLTL

SEQ ID NO: 8604 - protein, 51 aa, Canis lupus familiaris
GPRAGAVRHLLPQTCFSLVTGQTWICASPSSSRSIALTSGAMSSARTTITT

SEQ ID NO: 8605 - protein, 45 aa, Canis lupus familiaris
GPRALRSRNVRVKMASRAMLFCRIMKVQKTLKVKKGSIVKRKTPK

SEQ ID NO: 8606 - skipped

SEQ ID NO: 8607 - protein, 63 aa, Canis lupus familiaris
GPRAPRAPAGRQVHRRLPQPPPAGTPSAPAACTGRSWGHARSPGAQAGRRGGSLPTELGPGAR

SEQ ID NO: 8608 - protein, 9 aa, Canis lupus familiaris
GPRAPRGAP

SEQ ID NO: 8609 - protein, 31 aa, Canis lupus familiaris
GPRARDTRAPRVAARPAGRGGPGTGPATRSS

SEQ ID NO: 8610 - protein, 43 aa, Canis lupus familiaris
GPRGACAGRAGSGVHGGAQAGGLGDPPRPPCGAQASSAAAVGC

SEQ ID NO: 8611 - protein, 10 aa, Canis lupus familiaris
GPRGAQWAGS

SEQ ID NO: 8612 - skipped

SEQ ID NO: 8613 - protein, 37 aa, Canis lupus familiaris
GPRIWGARLRFGEARSRLPRPVPASKGASAPRPLSQR

SEQ ID NO: 8614 - protein, 40 aa, Canis lupus familiaris
GPRPCREDAPPWGPPQGLWAAGQGQGRGAASPLTASKEKV

SEQ ID NO: 8615 - protein, 31 aa, Canis lupus familiaris
GPRPLLMASLLQLPLLFLPLPLQVILFSSTV

SEQ ID NO: 8616 - protein, 74 aa, Canis lupus familiaris
GPRPRPGAPRGPSAVWDAAPVWPRTSWRSACGRAPRPPGPALTRHPQHHRPPRHPVGPAPWPRRPRHHPPPTPS

SEQ ID NO: 8617 - protein, 30 aa, Canis lupus familiaris
GPRRHQLPSPKTEMPSKSRSADGWSKLGSE

SEQ ID NO: 8618 - protein, 20 aa, Canis lupus familiaris
GPRRSPSRRRRSLRRMGSWC

SEQ ID NO: 8619 - protein, 24 aa, Canis lupus familiaris
GPSAGSCMHEDRHSVYPGQLGLPG

SEQ ID NO: 8620 - protein, 14 aa, Canis lupus familiaris
GPSAVSRWSSAPST

SEQ ID NO: 8621 - protein, 13 aa, Canis lupus familiaris
GPSGAGQSLDPSD

SEQ ID NO: 8622 - protein, 29 aa, Canis lupus familiaris
GPSGRSVPRVLICGVRVQASPPRFRAPFK

SEQ ID NO: 8623 - protein, 67 aa, Canis lupus familiaris
GPSGRSVPRVLICGVRVQASPPRFRAPFKDAEDLGAALPGLGQLPLLRRHCPLHQWLPAHSFGTHQP

SEQ ID NO: 8624 - protein, 9 aa, Canis lupus familiaris
GPSLQAPST

SEQ ID NO: 8625 - protein, 28 aa, Canis lupus familiaris
GPSPSGPQCLQDPLPHSAKDHYQPRPAL

SEQ ID NO: 8626 - protein, 25 aa, Canis lupus familiaris
GPSQGRRCLLFSGAIYPPPPTPRAL

SEQ ID NO: 8627 - protein, 54 aa, Canis lupus familiaris
GPSSGQHLGRGARLSAQGVPHGAPPRRHGARMLPAVCGVASRQGRFLSRLLADG

SEQ ID NO: 8628 - protein, 31 aa, Canis lupus familiaris
GPSSIFCLWKALSGAYKSPAKRGKRERSSLL

SEQ ID NO: 8629 - protein, 16 aa, Canis lupus familiaris
GPSSLCSTTMWIPSNP

SEQ ID NO: 8630 - protein, 28 aa, Canis lupus familiaris
GPSSSFPCIRRENWTPTTQRSAGTKGTS

SEQ ID NO: 8631 - protein, 26 aa, Canis lupus familiaris
GPSSSWVTPSMKWEGIQGFSTNTWGQ

SEQ ID NO: 8632 - protein, 76 aa, Canis lupus familiaris
GPSSSWVTVGSSAGGGGARRLSHRALSGGAETSCISSMWVLGTVLALAPGLLTTLPSQPSMKWEGIQGFSTNTWGQ

SEQ ID NO: 8633 - skipped

SEQ ID NO: 8634 - protein, 10 aa, Canis lupus familiaris
GPTGRTQSSR

SEQ ID NO: 8635 - skipped

SEQ ID NO: 8636 - protein, 18 aa, Canis lupus familiaris
GPTPTPQEPSTPHGPGPG

SEQ ID NO: 8637 - protein, 41 aa, Canis lupus familiaris
GPTRGNLLPWRTSVARLNQGARDTFRGLTASVLSASQVPSR

SEQ ID NO: 8638 - skipped

SEQ ID NO: 8639 - protein, 12 aa, Canis lupus familiaris
GPVAMTQSWSPA

SEQ ID NO: 8640 - protein, 34 aa, Canis lupus familiaris
GPVLARPERPEVSPRQSRSVPGPGRELERAGYSL

SEQ ID NO: 8641 - protein, 86 aa, Canis lupus familiaris
GPVLHHRLWPGAPAGQRRSLEFHYQRSIDWGCAGCPQWPIGHGGLSNDGGHPLGSHRGCWHPPYSLYCPAVPQCTPVLGGPQPATP

SEQ ID NO: 8642 - protein, 8 aa, Canis lupus familiaris
GPVQGATP

SEQ ID NO: 8643 - protein, 49 aa, Canis lupus familiaris
GPVRPLRQSVALVDGGFLQPLPAQGGVHRPPVRQFHCLQPAGERKAHPW

SEQ ID NO: 8644 - protein, 51 aa, Canis lupus familiaris
GPVSRCALILLSGESKTGVQLGRKRKPLGGQGLTSRVRSGSLTPGGRYTCA

SEQ ID NO: 8645 - skipped

SEQ ID NO: 8646 - protein, 25 aa, Canis lupus familiaris
GPWGAGFVLCPQDYQEASRPRLRLG

SEQ ID NO: 8647 - protein, 23 aa, Canis lupus familiaris
GPWGTPSCPAGAKRTSTATSAGP

SEQ ID NO: 8648 - protein, 23 aa, Canis lupus familiaris
GPWNQCPLRRTRRRTRQPASSQT

SEQ ID NO: 8649 - protein, 20 aa, Canis lupus familiaris
GPWPLTPTKGSPRPCSGMRR

SEQ ID NO: 8650 - protein, 43 aa, Canis lupus familiaris
GPWQAFSLPSTWLAWSCVTPPTAWYSPRQLASSRCWALCCCRA

SEQ ID NO: 8651 - protein, 8 aa, Canis lupus familiaris
GPWRKPRL

SEQ ID NO: 8652 - protein, 14 aa, Canis lupus familiaris
GPWRSTQRWLSTSI

SEQ ID NO: 8653 - protein, 17 aa, Canis lupus familiaris
GPWVGWLLRGRCSLQMI

SEQ ID NO: 8654 - skipped

SEQ ID NO: 8655 - protein, 55 aa, Canis lupus familiaris
GQAHRRLLVVAGRPKAPKTNSPGRAQARPPLGNPRRPSPGSTSRRSTRGRRCPRS

SEQ ID NO: 8656 - protein, 11 aa, Canis lupus familiaris
GQALHPGRLVG

SEQ ID NO: 8657 - protein, 13 aa, Canis lupus familiaris
GQALLAGDTQKNI

SEQ ID NO: 8658 - skipped

SEQ ID NO: 8659 - protein, 80 aa, Canis lupus familiaris
GQAVQGGPRNGPLSPSPAAAVSLSPPAVGAASGGAGSRVGLVMGALPLPEARQGVSPISEPTLGSIPMGHPRGWPSPIIP

SEQ ID NO: 8660 - skipped

SEQ ID NO: 8661 - protein, 56 aa, Canis lupus familiaris
GQEAVPRLASSGPWQSVASLWTWSEGHLLGPSWVPCTPRSGTTARSGSGPRSGLRT

SEQ ID NO: 8662 - protein, 23 aa, Canis lupus familiaris
GQEEIRTRYLDLRYEELFSDGGD

SEQ ID NO: 8663 - protein, 37 aa, Canis lupus familiaris
GQERGSLRSSTQSSLPCSTLSSTLCATRRSSGLCKDF

SEQ ID NO: 8664 - protein, 30 aa, Canis lupus familiaris
GQEWGSPGARGRGRGAGAAGTPPSGPCTLR

SEQ ID NO: 8665 - skipped

SEQ ID NO: 8666 - protein, 11 aa, Canis lupus familiaris
GQGFRRRPRCG

SEQ ID NO: 8667 - protein, 18 aa, Canis lupus familiaris
GQGGREHSRSLSASGGTC

SEQ ID NO: 8668 - protein, 15 aa, Canis lupus familiaris
GQGLMPRKSVVFTML

SEQ ID NO: 8669 - protein, 41 aa, Canis lupus familiaris
GQGPVGRKDPVLLVPQKRLALRAQRVACPCSLPVLTLPPLM

SEQ ID NO: 8670-8671 - skipped (2 entries)

SEQ ID NO: 8672 - protein, 8 aa, Canis lupus familiaris
GQGTQYSG

SEQ ID NO: 8673 - protein, 14 aa, Canis lupus familiaris
GQHCILERAGRVDR

SEQ ID NO: 8674 - protein, 45 aa, Canis lupus familiaris
GQHSDCKWLLRLPHGLHKPRGQSENKEQLRGGAGPSPGNGRPAGV

SEQ ID NO: 8675 - protein, 27 aa, Canis lupus familiaris
GQKPSSAWPCRSVWAPLPPSPLAPLAS

SEQ ID NO: 8676 - protein, 8 aa, Canis lupus familiaris
GQLSVWPR

SEQ ID NO: 8677 - protein, 29 aa, Canis lupus familiaris
GQPEEATGPGASPCAPPEASRRSRSTRAS

SEQ ID NO: 8678 - protein, 49 aa, Canis lupus familiaris
GQPLLPLGPTPHPLCLCPQENQPCPGLMEPPLAVLLGAKRSRLTLSSGR

SEQ ID NO: 8679 - protein, 12 aa, Canis lupus familiaris
GQPPADAEGLPH

SEQ ID NO: 8680 - skipped

SEQ ID NO: 8681 - protein, 43 aa, Canis lupus familiaris
GQPRRKGSLDRGLPPSPPTRERPGHPQTRVPTHCRGPGRSRPL

SEQ ID NO: 8682 - protein, 36 aa, Canis lupus familiaris
GQQPGRPSRRPVRAAACTTARPTATRAAAATARASS

SEQ ID NO: 8683 - protein, 19 aa, Canis lupus familiaris
GQQRSRKAIFWFLRFWSFN

SEQ ID NO: 8684 - protein, 16 aa, Canis lupus familiaris
GQRAATQRPQERRAGA

SEQ ID NO: 8685 - protein, 21 aa, Canis lupus familiaris
GQRAHHLMSSRPLGAPCHFLC

SEQ ID NO: 8686 - protein, 40 aa, Canis lupus familiaris
GQRGREAQPGGQWGQSLRRARDGKSLPCPGFSGRGHFCQQ

SEQ ID NO: 8687 - protein, 10 aa, Canis lupus familiaris
GQRRGGGRGL

SEQ ID NO: 8688 - skipped

SEQ ID NO: 8689 - protein, 86 aa, Canis lupus familiaris
GQRRRRRKRRKKRRRRRRRSSSLPPPQPPAQLQRPQALPLARGPQPATQGQKMDRPPVSPSCPRCPHPCPGTCLLVWTAPPAVSWP

SEQ ID NO: 8690 - protein, 8 aa, Canis lupus familiaris
GQRWQVPH

SEQ ID NO: 8691 - protein, 32 aa, Canis lupus familiaris
GQRWWEDTAPEDKHIGAGRSACRREALQVLRV

SEQ ID NO: 8692 - skipped

SEQ ID NO: 8693 - protein, 8 aa, Canis lupus familiaris
GQTEPFLS

SEQ ID NO: 8694 - protein, 18 aa, Canis lupus familiaris
GQWGPPPVTIGTSSALGG

SEQ ID NO: 8695 - protein, 11 aa, Canis lupus familiaris
GQWNSPSQAWP

SEQ ID NO: 8696 - protein, 35 aa, Canis lupus familiaris
GRAADPSQGHGPGRGAAAPAVGVAGGHSGGAGCRC

SEQ ID NO: 8697 - protein, 68 aa, Canis lupus familiaris
GRAAGQPGLQVRAPPVPLQGLRAQRLLLSRWQEVRCHKRQPRSDVPRPWEEAGVQRVCPGQNLLWAVR

SEQ ID NO: 8698 - protein, 20 aa, Canis lupus familiaris
GRAARGGRRPRPAVNMASAR

SEQ ID NO: 8699 - skipped

SEQ ID NO: 8700 - protein, 59 aa, Canis lupus familiaris
GRAHGGRLLGGLRRRGPARRADVPGRGLPGAPGLPRPRALGRAAQPSALPPAPGAPPPL

SEQ ID NO: 8701 - protein, 87 aa, Canis lupus familiaris
GRAHRGVRGTNAPPPSVPSRRPGPQPSLPGEPLSLAPSTPFGDGGDRVRVFCPLPRRGSRRSCKLTKRLGRWRRQCLSSSPGRSSCS

SEQ ID NO: 8702 - skipped

SEQ ID NO: 8703 - protein, 49 aa, Canis lupus familiaris
GRAPEDRGPARCTRQSRTPLGSMRLAWGQGCSTAQRCRPSSSRSLKTPN

SEQ ID NO: 8704 - protein, 57 aa, Canis lupus familiaris
GRARAPRGRAWRRRALPHPSCAPQCTRARRRRRPLPPPRRAPLSGWASADREQEECG

SEQ ID NO: 8705 - protein, 19 aa, Canis lupus familiaris
GRARGARRSPHCWGPSTRG

SEQ ID NO: 8706 - skipped

SEQ ID NO: 8707 - protein, 9 aa, Canis lupus familiaris
GRASAPTPV

SEQ ID NO: 8708 - protein, 25 aa, Canis lupus familiaris
GRATCGAPRPARHYPAAAGGRGLSV

SEQ ID NO: 8709 - protein, 9 aa, Canis lupus familiaris
GRAVLAAKA

SEQ ID NO: 8710 - protein, 12 aa, Canis lupus familiaris
GRCIGRTGGQTR

SEQ ID NO: 8711 - protein, 41 aa, Canis lupus familiaris
GRCPEESTCKTIFMLQIFTCSRRDGTPIKWTTTLTSMKTTS

SEQ ID NO: 8712 - protein, 34 aa, Canis lupus familiaris
GRCRWRSWRTRGRRWLWRARPTALRFFSFPQVKI

SEQ ID NO: 8713 - protein, 32 aa, Canis lupus familiaris
GRCSCCRWTGVCHTLGQACTESRVLHLHHSKC

SEQ ID NO: 8714 - protein, 12 aa, Canis lupus familiaris
GREALRLPGSWM

SEQ ID NO: 8715 - protein, 19 aa, Canis lupus familiaris
GREAPRQDTVSQMPQGAWL

SEQ ID NO: 8716 - protein, 23 aa, Canis lupus familiaris
GREGGGGRGPLQPLQEDVFSQED

SEQ ID NO: 8717 - protein, 18 aa, Canis lupus familiaris
GREIQTNPEIQPPRGSAH

SEQ ID NO: 8718 - protein, 79 aa, Canis lupus familiaris
GRFLTRHCQRASRTPWTLSCLTTTRRQRPSAATMMTRTRTPWRTTPSYRSRPATRPSHSWPTPAPARPHHPPSSPASPP

SEQ ID NO: 8719 - protein, 26 aa, Canis lupus familiaris
GRGAGTARRGARLQRGLLQGLCEGCP

SEQ ID NO: 8720 - protein, 66 aa, Canis lupus familiaris
GRGAGVRPAEPSGGERMEDRWPQRWKWKDAARSAWCTAAGKGRVRRALPRVGRGAPRGRTLCQMSE

SEQ ID NO: 8721 - protein, 30 aa, Canis lupus familiaris
GRGAPARAQRPPPRGTATGGPSPEGAARRR

SEQ ID NO: 8722 - skipped

SEQ ID NO: 8723 - protein, 60 aa, Canis lupus familiaris
GRGAPGRRRRRRVDPQGQLHPQAGARLAAPRRQGPGARGLLHRAVHGLHRSPPLHALSGF

SEQ ID NO: 8724 - protein, 11 aa, Canis lupus familiaris
GRGAQTREKIL

SEQ ID NO: 8725 - protein, 13 aa, Canis lupus familiaris
GRGARGARGARGA

SEQ ID NO: 8726 - protein, 98 aa, Canis lupus familiaris
GRGEAVFSNAPASASPPSLPRLTRRPRWRTTRMPGETAPPGITPRRKALGATERQGARAGAPSSAPALAAAACPRGASSPTLPTRQPCTQPATRWSPS

SEQ ID NO: 8727 - protein, 93 aa, Canis lupus familiaris
GRGGGFAEPQAERQYLRAFPGRSGLRGTADIDTRCQLQRSKKLPFCLYCLLPHELPFGQRGLLPDTRSAPKCQPEGDQESLLPAGQEIPPGHK

SEQ ID NO: 8728 - protein, 39 aa, Canis lupus familiaris
GRGGGGGRGGRRGGGGGGGAAACHHHSHQHSCSGPKHCP

SEQ ID NO: 8729 - protein, 44 aa, Canis lupus familiaris
GRGGPAPAGRGHPRALRPLRGPLPVRPGGGASRRGRGAGSRGQL

SEQ ID NO: 8730 - protein, 70 aa, Canis lupus familiaris
GRGGPGSWGALPGAGGDAGEVSGAWGQGPQAAGHPRAPRKWRKRGRRESVADPGPLSRRPAPLRPPPARG

SEQ ID NO: 8731 - skipped

SEQ ID NO: 8732 - protein, 17 aa, Canis lupus familiaris
GRGGRGGRRAPRRRVPR

SEQ ID NO: 8733 - protein, 89 aa, Canis lupus familiaris
GRGGRGRGPRGRGQPGAAAVRAAPEAHRHLHRQPARAAHQVRGVQRPHPAGDPDPGGKAGPVHLQTAAVQAECGSWREDPRAQQLPPFQ

SEQ ID NO: 8734 - protein, 14 aa, Canis lupus familiaris
GRGGRRAPRRRVPR

SEQ ID NO: 8735 - protein, 9 aa, Canis lupus familiaris
GRGGVHTLT

SEQ ID NO: 8736 - protein, 63 aa, Canis lupus familiaris
GRGKNWTQRTPRHAAVWPWGSPLPMALPLLAFPGLHPLGLACIRHHPARPPHLALGRASLPGQ

SEQ ID NO: 8737 - protein, 50 aa, Canis lupus familiaris
GRGLGAPGQGPAGRAGGGTAPTEEFLPPLPLQAGHVGHAQPEGLPRGEPV

SEQ ID NO: 8738 - protein, 47 aa, Canis lupus familiaris
GRGPAGRSGQEPGEAGSVRHVPGAGLRRDRKRKWLLGGARGSAGARA

SEQ ID NO: 8739 - protein, 36 aa, Canis lupus familiaris
GRGPGGPRGDRPGEPGSARWATRRDGSAGRPLFPRP

SEQ ID NO: 8740 - protein, 20 aa, Canis lupus familiaris
GRGPPKERANQARRSLQELS

SEQ ID NO: 8741 - protein, 74 aa, Canis lupus familiaris
GRGPRRTPRPSPPRPRAQPAARGPGPGGGPRPHRLHVKMKLNKHKSLLIIYLIVSLQYLLTVKKAQCIKVHSCL

SEQ ID NO: 8742 - protein, 36 aa, Canis lupus familiaris
GRGPSPQWHSGPRGWRRQEAVGVRVHHVALGLIVLR

SEQ ID NO: 8743 - protein, 19 aa, Canis lupus familiaris
GRGQGAVPQTFPHAAGPPV

SEQ ID NO: 8744 - protein, 24 aa, Canis lupus familiaris
GRGQRPGHAAGGSREGLGPVPVQP

SEQ ID NO: 8745 - protein, 14 aa, Canis lupus familiaris
GRGRCVSPSINCGT

SEQ ID NO: 8746 - protein, 29 aa, Canis lupus familiaris
GRGRGLHRDDAEEPDPERDDHRVRAQRQG

SEQ ID NO: 8747 - skipped

SEQ ID NO: 8748 - protein, 9 aa, Canis lupus familiaris
GRGRRGERL

SEQ ID NO: 8749 - protein, 22 aa, Canis lupus familiaris
GRGRTEAEVRAGNRRRWSSGDP

SEQ ID NO: 8750 - protein, 13 aa, Canis lupus familiaris
GRGSFISWFRSFP

SEQ ID NO: 8751 - protein, 47 aa, Canis lupus familiaris
GRGSLPGARGALPWGVAAPGLSSAAVLPPGACAPSPSLGDPPAADGL

SEQ ID NO: 8752 - protein, 45 aa, Canis lupus familiaris
GRGSPAQRPPPPRAAPASSRPHPRLQPSRLLEPLQVFRAGCGLGE

SEQ ID NO: 8753 - protein, 29 aa, Canis lupus familiaris
GRGVAGVSRSLVVPGPAAQGHAISARAAP

SEQ ID NO: 8754 - protein, 36 aa, Canis lupus familiaris
GRGVLLPPVSATRRMTSESPARISTASPPYHPARRL

SEQ ID NO: 8755 - protein, 23 aa, Canis lupus familiaris
GRGWGRQQHLPQDVPWPGPLRHL

SEQ ID NO: 8756 - protein, 25 aa, Canis lupus familiaris
GRHPPGSTRYPSFPLQLVPLSLIGP

SEQ ID NO: 8757 - protein, 8 aa, Canis lupus familiaris
GRHQGQRG

SEQ ID NO: 8758 - protein, 43 aa, Canis lupus familiaris
GRHTAPAGTWPLPPKCPTALQMHRVPQGPRGLHPGHPNPHVRG

SEQ ID NO: 8759-8761 - skipped (3 entries)

SEQ ID NO: 8762 - protein, 80 aa, Canis lupus familiaris
GRKQWRLWPCSLPSTATSQPPSSSWMRSMLPWITPTLARWQITSRSSRLATSRPSSSLSRRSSTPRLRASLESTPSKGTV

SEQ ID NO: 8763 - protein, 40 aa, Canis lupus familiaris
GRKTRGFLAVPKGPPALRAPGLQRRQLSPRACQGGICLQR

SEQ ID NO: 8764 - protein, 32 aa, Canis lupus familiaris
GRLLRQSPGRVPGGPAAQGAGACQAAARGPGG

SEQ ID NO: 8765 - protein, 50 aa, Canis lupus familiaris
GRLPRPVPALGARRRLWAAAPRVARGCPAAAWGPRRRRASWTCGRRRPST

SEQ ID NO: 8766 - protein, 25 aa, Canis lupus familiaris
GRLQATDAPPRHFYCRRPRCRGRPR

SEQ ID NO: 8767 - protein, 45 aa, Canis lupus familiaris
GRLSHLSDRDCTDIQGLLLQPQPRQTLLLPHADSGEAGLYRQQPH

SEQ ID NO: 8768 - protein, 65 aa, Canis lupus familiaris
GRPAGLRGPREAPEEDRTVAAALSTKTNKPLSVFGQLTICRAHNNEIRSVQNEPHDRHGVVWFRG

SEQ ID NO: 8769 - protein, 9 aa, Canis lupus familiaris
GRPAQCKLE

SEQ ID NO: 8770 - protein, 65 aa, Canis lupus familiaris
GRPASSRCTTPSPRRRAAASRSRSPGRPPRPRPPRPRPPRRPPGPWPRRPPPPTPTRSTGKPRRC

SEQ ID NO: 8771 - protein, 53 aa, Canis lupus familiaris
GRPCTPGRACGGWARACRSAAQRPLPSRRRSRRATPRAASKCGATPRGRRGCR

SEQ ID NO: 8772 - protein, 76 aa, Canis lupus familiaris
GRPGLARHAATTAAAALGHGPRRDGGRSGADPAAAPLSHCLRQDGAGEQVPARTHGREGLARPVLHSRHAATDGRN

SEQ ID NO: 8773 - protein, 56 aa, Canis lupus familiaris
GRPGLSCYGSLCCAGLHPCSVCHGSDLLAGPTGCPQVGFPLSDGLADAVSPGAAVY

SEQ ID NO: 8774 - protein, 31 aa, Canis lupus familiaris
GRPGPQRALRQPLTVPERREHPAPTKASRGL

SEQ ID NO: 8775 - protein, 25 aa, Canis lupus familiaris
GRPKPVRSTSARSTVAPPCRIAWKR

SEQ ID NO: 8776 - protein, 63 aa, Canis lupus familiaris
GRPLIWNLDPGAPLQGWCPGRGPGAVRRLPLGAREEEETQPAARAAGGPRLSPLGGRRAEGAG

SEQ ID NO: 8777 - protein, 47 aa, Canis lupus familiaris
GRPPGPERAGSEGHPRAPTPHGRSRTRPRPLVPRGLRRGSSGSGYWG

SEQ ID NO: 8778 - protein, 50 aa, Canis lupus familiaris
GRPPQHRVRGVRRRHQHLLLASPHPDCALHPHLCAWLRDSAGGDAPGHSL

SEQ ID NO: 8779-8780 - skipped (2 entries)

SEQ ID NO: 8781 - protein, 12 aa, Canis lupus familiaris
GRPRAQLPLPPP

SEQ ID NO: 8782 - protein, 25 aa, Canis lupus familiaris
GRPRGPSAPPGPRRCASAASPSCPS

SEQ ID NO: 8783 - protein, 74 aa, Canis lupus familiaris
GRPRGTASGSSSTPRPRTPRALSSACWPVMGTLASSRTGTEPAASWAPAAGTSATCHDPSRHGSRTGGTGCVCP

SEQ ID NO: 8784 - protein, 75 aa, Canis lupus familiaris
GRPRGTASGSSSTPRPRTPSRALSSACWPVMGTLASSRTGTEPAASWAPAAGTSATCHDPSRHGSRTGGTGCVCP

SEQ ID NO: 8785 - protein, 72 aa, Canis lupus familiaris
GRPRPPLLLAPGSLPLCLLAAPAGDSRSPDRPGYHPWTPTTHTRGPGLCDANKQDRLPVPRPEELHPSQRGL

SEQ ID NO: 8786 - protein, 27 aa, Canis lupus familiaris
GRPRRRRRRSQTGGARRKAPPGPGCAL

SEQ ID NO: 8787 - protein, 28 aa, Canis lupus familiaris
GRPRSGARPPRGPSGPRCSTTRRRAMRS

SEQ ID NO: 8788 - protein, 18 aa, Canis lupus familiaris
GRPSPPGTPSMASRSVAG

SEQ ID NO: 8789 - protein, 38 aa, Canis lupus familiaris
GRPSRSCPDHWHSGVPARILPPAHCLLCFQRLPGLLLR

SEQ ID NO: 8790 - protein, 16 aa, Canis lupus familiaris
GRPTGPGCARGTASWR

SEQ ID NO: 8791 - protein, 15 aa, Canis lupus familiaris
GRPWGAAVAAAARRI

SEQ ID NO: 8792 - protein, 12 aa, Canis lupus familiaris
GRPYREARGTGP

SEQ ID NO: 8793 - protein, 38 aa, Canis lupus familiaris
GRQAHPWRGKAVAPLSQGPLEIARALSCCHPRAPLIPL

SEQ ID NO: 8794 - protein, 20 aa, Canis lupus familiaris
GRQALETAQETMGEGVQAPR

SEQ ID NO: 8795 - protein, 22 aa, Canis lupus familiaris
GRQCQGQGGHRADGRPDTAQEG

SEQ ID NO: 8796 - protein, 16 aa, Canis lupus familiaris
GRQGEICCPGEHQLQD

SEQ ID NO: 8797 - protein, 39 aa, Canis lupus familiaris
GRQGVRSSREERQQESGRGKARERALTFGGAVLGAADEK

SEQ ID NO: 8798 - protein, 64 aa, Canis lupus familiaris
GRQPGAELGRWPRAPADSCGRITVEQLRVIAATADRHQPGPTEDGAEAGLVRGRGPGQPAAAVL

SEQ ID NO: 8799 - protein, 39 aa, Canis lupus familiaris
GRQPPVHIPAEHARPPGDDRLAMGLLHQPQRSRLPHQDE

SEQ ID NO: 8800 - protein, 14 aa, Canis lupus familiaris
GRQRQQRWRQQGVW

SEQ ID NO: 8801 - protein, 57 aa, Canis lupus familiaris
GRQVWPPWCIGWWRPCPSCRRRKLGYRRSWQPFRRGWPSKTVTSKPHPPSCRTRWKT

SEQ ID NO: 8802 - protein, 22 aa, Canis lupus familiaris
GRRAGPVGTAGRADRAGAGHQQ

SEQ ID NO: 8803 - protein, 27 aa, Canis lupus familiaris
GRRAWAGGSVPLTAPCCSWRTSFTSSV

SEQ ID NO: 8804 - protein, 20 aa, Canis lupus familiaris
GRRAWGGRGGWRGCELRLRP

SEQ ID NO: 8805 - protein, 8 aa, Canis lupus familiaris
GRREERGK

SEQ ID NO: 8806 - protein, 20 aa, Canis lupus familiaris
GRRGGQSQDRQEGCAAGRAG

SEQ ID NO: 8807 - protein, 13 aa, Canis lupus familiaris
GRRGRAGPGPKRV

SEQ ID NO: 8808 - protein, 15 aa, Canis lupus familiaris
GRRGVGGGRGGGRGG

SEQ ID NO: 8809 - skipped

SEQ ID NO: 8810 - protein, 93 aa, Canis lupus familiaris
GRRPAGRGSRSPRAPGASLPPATQLICTIGAERTRVWPRRTARGRPAPGTGSGRCAGGQQPGRPSRRPVRAAACTTARPTATRAAAATARASS

SEQ ID NO: 8811 - protein, 40 aa, Canis lupus familiaris
GRRPASQAARELDRHSGDTARGNALQPQVPGHDAGGAAQG

SEQ ID NO: 8812 - protein, 15 aa, Canis lupus familiaris
GRRPKSSGCPAPRSR

SEQ ID NO: 8813 - protein, 52 aa, Canis lupus familiaris
GRRPRSQGQGQGGQKAREAREAREAREAREGEEEEAEKREGRQVAQGEEGKG

SEQ ID NO: 8814 - skipped

SEQ ID NO: 8815 - protein, 61 aa, Canis lupus familiaris
GRRRRRRRRGGGGGAPAAAGRGLRSRRGAAAPGPAAAPPPRLVHPVGAEGAGERFPTRSIP

SEQ ID NO: 8816 - protein, 17 aa, Canis lupus familiaris
GRRRRRRRRGRGPGRGR

SEQ ID NO: 8817-8819 - skipped (3 entries)

SEQ ID NO: 8820 - protein, 8 aa, Canis lupus familiaris
GRRTEGCL

SEQ ID NO: 8821 - protein, 13 aa, Canis lupus familiaris
GRRTLRPSPVLWP

SEQ ID NO: 8822 - protein, 48 aa, Canis lupus familiaris
GRRTVPMASVYSAKSQSQPRRPGIIQSEDNSTCQTQTSISSSFKNRNS

SEQ ID NO: 8823 - protein, 31 aa, Canis lupus familiaris
GRRWLWRGDGGARPGLLRPLRHVLAASILQR

SEQ ID NO: 8824 - protein, 92 aa, Canis lupus familiaris
GRRWRRRRPKKRRRKRASSCRLCRRPRVRRRPRPRPGPGRAKRRRERRARDPRASPGRPPRPLPSRPRASASRPSRWRASARRCYRRATPAA

SEQ ID NO: 8825 - skipped

SEQ ID NO: 8826 - protein, 35 aa, Canis lupus familiaris
GRSCCGRSPPRRRYLLREHIHLHPGTLLHLRGWRL

SEQ ID NO: 8827 - protein, 22 aa, Canis lupus familiaris
GRSCRRRTAWPSTSAGWCPRPS

SEQ ID NO: 8828 - protein, 52 aa, Canis lupus familiaris
GRSGGPCGLLHNRHSHAQPFHLHSAQQGGQAGSAKTFEPRPAGVPVRQPAPL

SEQ ID NO: 8829 - protein, 22 aa, Canis lupus familiaris
GRSGHLNVCLWVKWLRRSERCA

SEQ ID NO: 8830 - protein, 9 aa, Canis lupus familiaris
GRSGTPTPC

SEQ ID NO: 8831 - protein, 41 aa, Canis lupus familiaris
GRSRSAAPRPRGSCPPSPGTPARMTAACSCLSRGPAEMWPQ

SEQ ID NO: 8832 - protein, 8 aa, Canis lupus familiaris
GRSSLTAG

SEQ ID NO: 8833 - protein, 16 aa, Canis lupus familiaris
GRSTGWTRREKRSFPC

SEQ ID NO: 8834 - protein, 43 aa, Canis lupus familiaris
GRSVLFANDVYVERGAVSSQQVCLFQRVCKTLRFFQLQDENLH

SEQ ID NO: 8835 - protein, 33 aa, Canis lupus familiaris
GRTEQGAGRPPGAPSCAGQLGCAGGPGHELPTQ

SEQ ID NO: 8836 - protein, 28 aa, Canis lupus familiaris
GRTRPACSSSRRSPTAPCSSPSGGRRPS

SEQ ID NO: 8837 - protein, 35 aa, Canis lupus familiaris
GRTTPASCRSALCPSSPVLRTRDGPGGSASHDHCG

SEQ ID NO: 8838 - skipped

SEQ ID NO: 8839 - protein, 19 aa, Canis lupus familiaris
GRVAASRGTAAPGRGGAAP

SEQ ID NO: 8840 - protein, 22 aa, Canis lupus familiaris
GRVAHSPASCCPGAHAAAAGGL

SEQ ID NO: 8841 - protein, 28 aa, Canis lupus familiaris
GRVGESGDQGGRANARSLGGGCPPGMRV

SEQ ID NO: 8842 - protein, 16 aa, Canis lupus familiaris
GRVHHQLQGPPGEPDG

SEQ ID NO: 8843 - protein, 20 aa, Canis lupus familiaris
GRVPWEGRTPCYLCPRRDWH

SEQ ID NO: 8844 - protein, 62 aa, Canis lupus familiaris
GRVSCVRAPGAPAAPLGSPALRGGRRGGPRGAVSARGWESSQEPGDRLPPPARPPRAPRPRP

SEQ ID NO: 8845 - protein, 8 aa, Canis lupus familiaris
GRVSGFGC

SEQ ID NO: 8846 - protein, 81 aa, Canis lupus familiaris
GRVSPSGLEGAPPQWPPARPPPLCSPPAEPIGPRRCPRPPVAARPGRSPSSDCQVPAAVRHPPSSDPQLRSPAPIWAPPSP

SEQ ID NO: 8847 - protein, 28 aa, Canis lupus familiaris
GRWGPVGRVDDKRTVSADSSDPDAAAAL

SEQ ID NO: 8848 - protein, 11 aa, Canis lupus familiaris
GRWLMMMLFRF

SEQ ID NO: 8849 - protein, 35 aa, Canis lupus familiaris
GRWLRCTRAPPRAPGSPHLPRGRRPGPRRRKRTGC

SEQ ID NO: 8850 - protein, 99 aa, Canis lupus familiaris
GRWSACARPCSFSACCTFSWPSSSTLTSTPSTWPSSAASAPVALPAPSTQLPAAAPTSPGPTPRPPARGSPRLPAPVLAPRLPSCLPVPTRRLVLWAGC

SEQ ID NO: 8851 - protein, 40 aa, Canis lupus familiaris
GSAASRPLSSIARAAMAMSWTWAKALTPAWSGSLSWRWRA

SEQ ID NO: 8852 - protein, 14 aa, Canis lupus familiaris
GSAELGGRSAGSRN

SEQ ID NO: 8853 - protein, 74 aa, Canis lupus familiaris
GSAKFGAPRPAAPGPRGPPGRAPAPSGCRSSRRPSVRGQRRPGPHPAPSGQHLAAGRQRGVSWARAPPAAGARH

SEQ ID NO: 8854 - protein, 12 aa, Canis lupus familiaris
GSALHPGTRWTC

SEQ ID NO: 8855 - protein, 21 aa, Canis lupus familiaris
GSALPSPSRFPGNQSQENSIR

SEQ ID NO: 8856 - protein, 19 aa, Canis lupus familiaris
GSAPHLPRLTCLRDRSLLR

SEQ ID NO: 8857 - protein, 48 aa, Canis lupus familiaris
GSARPARAGRRGGSLAVAPGRGGGAQLRGRRDMAGAEAEAGRPHGRRD

SEQ ID NO: 8858 - protein, 9 aa, Canis lupus familiaris
GSASRRTSW

SEQ ID NO: 8859 - protein, 71 aa, Canis lupus familiaris
GSCPFGGGGPVPRRLVLPPLPLRRHPKCVRPALYSRGLGGSARCFSRCLGSGSSRAPPRCSSSRWRSTPRC

SEQ ID NO: 8860 - protein, 12 aa, Canis lupus familiaris
GSCPRPRARAWY

SEQ ID NO: 8861 - protein, 20 aa, Canis lupus familiaris
GSCSWLCSFCPPVCVGFIGK

SEQ ID NO: 8862 - protein, 23 aa, Canis lupus familiaris
GSDCGSLGGGPDPRCPRRSHRRL

SEQ ID NO: 8863 - skipped

SEQ ID NO: 8864 - protein, 34 aa, Canis lupus familiaris
GSFPCGQGELSCIPSQSGRLPWQQPLFQHRDPQG

SEQ ID NO: 8865 - protein, 28 aa, Canis lupus familiaris
GSFPLVPHQYPSWGMCCKSVLMPLFSLL

SEQ ID NO: 8866 - skipped

SEQ ID NO: 8867 - protein, 86 aa, Canis lupus familiaris
GSFRNAPSSRGRRPPSCAKPWSRGTPSLVLSPAPLATPPSTCYPRSTRRATTTWSAGASAPSSSSARRCAKTCSGWRRLNLGLFGV

SEQ ID NO: 8868 - protein, 61 aa, Canis lupus familiaris
GSGCDHLGERPQRHGLPRGRVPEAPRQRGLRRGADPLALRRAGQQLPHLHLRPLPPQPEPL

SEQ ID NO: 8869 - skipped

SEQ ID NO: 8870 - protein, 18 aa, Canis lupus familiaris
GSGLPLWMASTPRATRRC

SEQ ID NO: 8871 - protein, 18 aa, Canis lupus familiaris
GSGLTASPERGAGRPEMT

SEQ ID NO: 8872 - skipped

SEQ ID NO: 8873 - protein, 38 aa, Canis lupus familiaris
GSGPEFQHRPPEGGARPGALWTKVRPEDWDAGAQELSA

SEQ ID NO: 8874 - protein, 9 aa, Canis lupus familiaris
GSGPGSWRS

SEQ ID NO: 8875 - protein, 9 aa, Canis lupus familiaris
GSGPRQGQR

SEQ ID NO: 8876 - protein, 84 aa, Canis lupus familiaris
GSGRVLQPGPGAAGRPVQAVWQAAGGLALRAPRTPRASTEPRGRGCAQPGTDQHRRGAALEKRLRRPGHPAAGHQRLPVGLLCV

SEQ ID NO: 8877 - protein, 10 aa, Canis lupus familiaris
GSHFLANLNP

SEQ ID NO: 8878 - skipped

SEQ ID NO: 8879 - protein, 32 aa, Canis lupus familiaris
GSHQRLHQGGDSSRHGGPPCVWPGEGPRVCHH

SEQ ID NO: 8880 - protein, 18 aa, Canis lupus familiaris
GSISWSGPPSETPFLPSK

SEQ ID NO: 8881 - protein, 26 aa, Canis lupus familiaris
GSLALMPLTTLPDSSGHCASRVRHGP

SEQ ID NO: 8882 - protein, 12 aa, Canis lupus familiaris
GSLCEAAPFKCP

SEQ ID NO: 8883 - protein, 26 aa, Canis lupus familiaris
GSLCREPPFRISEEDQKEQTEDTWKR

SEQ ID NO: 8884 - protein, 54 aa, Canis lupus familiaris
GSLHTICCPTEEHHGEDGHPVQASVPALLDIWPCPGYAHRTHTCCGPHSCYLGT

SEQ ID NO: 8885 - protein, 13 aa, Canis lupus familiaris
GSLNAWVTWPPCP

SEQ ID NO: 8886 - protein, 12 aa, Canis lupus familiaris
GSLPPGCFWLCL

SEQ ID NO: 8887 - protein, 70 aa, Canis lupus familiaris
GSLRSAAPPGHSVHGPAVSHAGPVSRALLSHRAQAGLLCRRRAPRCGACAFRGAQPGIHGSPPHRPHKRG

SEQ ID NO: 8888 - protein, 82 aa, Canis lupus familiaris
GSLRSRQGVQQRGAPARCGRGGGQVFRSVCAPDAHGWVGQGRGRPAGAPRAHGLHRRAAQHPGERLPAAPLPGPPGAPAPGP

SEQ ID NO: 8889 - protein, 10 aa, Canis lupus familiaris
GSMWNSTVSV

SEQ ID NO: 8890 - protein, 11 aa, Canis lupus familiaris
GSNPLKGPRRA

SEQ ID NO: 8891 - protein, 25 aa, Canis lupus familiaris
GSPGGGVPARGSGRSGPSAATCGPH

SEQ ID NO: 8892 - protein, 8 aa, Canis lupus familiaris
GSPRGPSA

SEQ ID NO: 8893 - protein, 11 aa, Canis lupus familiaris
GSPSPRAANTP

SEQ ID NO: 8894 - protein, 86 aa, Canis lupus familiaris
GSQRPRAPAAVPDPSIRRCCPFRRALSWRRPKSLRPGLGTRVGRLPQLPPPRTRRDPHHYLCRGRHPSRPPPPPGPWRPARADGRV

SEQ ID NO: 8895 - protein, 9 aa, Canis lupus familiaris
GSQRQGVAC

SEQ ID NO: 8896 - protein, 11 aa, Canis lupus familiaris
GSQVCWRCGCW

SEQ ID NO: 8897 - protein, 14 aa, Canis lupus familiaris
GSRCRARGCRRLPR

SEQ ID NO: 8898 - protein, 23 aa, Canis lupus familiaris
GSRERSPRRGSGERRPRGKGRSG

SEQ ID NO: 8899 - skipped

SEQ ID NO: 8900 - protein, 23 aa, Canis lupus familiaris
GSRIGKTSVKGAPGGSAGEASLL

SEQ ID NO: 8901 - protein, 47 aa, Canis lupus familiaris
GSRLHAPVPACHGAGLDPVCGRGGRPRRAPGPPAGLRLAGGHHGASE

SEQ ID NO: 8902 - protein, 19 aa, Canis lupus familiaris
GSRLLGSGSTAPVWSPGRP

SEQ ID NO: 8903 - skipped

SEQ ID NO: 8904 - protein, 32 aa, Canis lupus familiaris
GSRNRRRRSSPPAPASATSWCTRGAGARTRTT

SEQ ID NO: 8905 - protein, 23 aa, Canis lupus familiaris
GSRPWAAPHSSSQPPPPMASTTS

SEQ ID NO: 8906 - protein, 73 aa, Canis lupus familiaris
GSRRRPGKPRSPGPPGSCALGRAGRPTTPAAPAAPGTAPATRKAAAAAAPLTPAPSTRPQTRRQSLFVSCFLT

SEQ ID NO: 8907 - skipped

SEQ ID NO: 8908 - protein, 31 aa, Canis lupus familiaris
GSRRWRVRTWTPGLRTRPKTPRAKRTARFWM

SEQ ID NO: 8909 - skipped

SEQ ID NO: 8910 - protein, 18 aa, Canis lupus familiaris
GSRSQGWFGGSWENWARG

SEQ ID NO: 8911 - protein, 14 aa, Canis lupus familiaris
GSSCSRNSSPLPAA

SEQ ID NO: 8912 - protein, 15 aa, Canis lupus familiaris
GSSISTPLTPHCPRR

SEQ ID NO: 8913 - protein, 28 aa, Canis lupus familiaris
GSSLKTTGSSQQPTVKKGSTQYAWGITA

SEQ ID NO: 8914 - skipped

SEQ ID NO: 8915 - protein, 18 aa, Canis lupus familiaris
GSSLQDPPHCPSSEITCS

SEQ ID NO: 8916 - protein, 44 aa, Canis lupus familiaris
GSSLTAGGSSQLLTAVAAGTGCAWGSIASAGWTGRRRFGEVASP

SEQ ID NO: 8917 - protein, 11 aa, Canis lupus familiaris
GSSRGARAAVQ

SEQ ID NO: 8918 - protein, 12 aa, Canis lupus familiaris
GSSSSSPPASST

SEQ ID NO: 8919 - protein, 29 aa, Canis lupus familiaris
GSSTCPRPIILYTSGPGTCSNPTWFCCSQ

SEQ ID NO: 8920 - protein, 64 aa, Canis lupus familiaris
GSTGAAVSWWISWPWLPPWSPPFCGHSVLGGGARIPSTTSEPCSGAAAWSPCIRCAAPPSTSKP

SEQ ID NO: 8921 - protein, 19 aa, Canis lupus familiaris
GSTPTPTCPATLTPTCPHT

SEQ ID NO: 8922 - protein, 38 aa, Canis lupus familiaris
GSTRQQHFTSGMEKDEEPQGQRELPFDSRQTAECKHPQ

SEQ ID NO: 8923 - protein, 8 aa, Canis lupus familiaris
GSTSKNTR

SEQ ID NO: 8924 - protein, 65 aa, Canis lupus familiaris
GSTSWWASYGTSGGVVCSSGSPSWTATLNCSSWSRPCSQCCPRDCVSWPWSGTCLCLCLPWCWAG

SEQ ID NO: 8925 - protein, 37 aa, Canis lupus familiaris
GSVAPSLGGLMVERSRPSGNMEQGEGLSGEIFWKMQE

SEQ ID NO: 8926 - protein, 45 aa, Canis lupus familiaris
GSVELTIPGLAMTHPLSLNQTLAHPLLALMCAWLTLRGSVQNLEG

SEQ ID NO: 8927 - protein, 18 aa, Canis lupus familiaris
GSVMRAEIDTWCRWPSCP

SEQ ID NO: 8928 - protein, 11 aa, Canis lupus familiaris
GSVWEHPTIGS

SEQ ID NO: 8929 - protein, 29 aa, Canis lupus familiaris
GSWPACHLPLSTSPLSCAACPSAWRPSQN

SEQ ID NO: 8930 - protein, 33 aa, Canis lupus familiaris
GSWPPESVHKPGQRNKNGDVRLLWTAVQTSPSL

SEQ ID NO: 8931 - protein, 32 aa, Canis lupus familiaris
GSWRVIQEVNPPNQHQTGAPRDLLVCLMICGL

SEQ ID NO: 8932 - skipped

SEQ ID NO: 8933 - protein, 52 aa, Canis lupus familiaris
GTAAPARLAWTPGGTSPSPGPGPAPGRPGAPSPVYIKWCYSRPGSRLSPKAP

SEQ ID NO: 8934 - protein, 29 aa, Canis lupus familiaris
GTAPRRSWMAFLFITASHGASPCMGQMAC

SEQ ID NO: 8935 - protein, 12 aa, Canis lupus familiaris
GTAQATTPHVPR

SEQ ID NO: 8936 - protein, 12 aa, Canis lupus familiaris
GTAVVGRHCPRR

SEQ ID NO: 8937 - skipped

SEQ ID NO: 8938 - protein, 14 aa, Canis lupus familiaris
GTCPRSCSGICMRA

SEQ ID NO: 8939 - protein, 14 aa, Canis lupus familiaris
GTEARGRASRTAMS

SEQ ID NO: 8940 - protein, 17 aa, Canis lupus familiaris
GTEIGIKPTSPRKCNQK

SEQ ID NO: 8941 - protein, 25 aa, Canis lupus familiaris
GTGHLWSPSTRPTLPCCSWRARPLC

SEQ ID NO: 8942 - skipped

SEQ ID NO: 8943 - protein, 24 aa, Canis lupus familiaris
GTGMWVLWRRDVCGFISPHHGRVV

SEQ ID NO: 8944 - protein, 72 aa, Canis lupus familiaris
GTGPRLGLGGPAVAVAGRWRSAARPSAASTTRPRCFNTATMTICRARAAWRWTTACRRWSSGCSCRKTSSRS

SEQ ID NO: 8945 - protein, 68 aa, Canis lupus familiaris
GTGPRSQPTSRSRATGCGGKAAGMRLPRVRGRATLRGAVRPNGTCILSINLKDMKTVMLTGQVRAAAS

SEQ ID NO: 8946 - protein, 18 aa, Canis lupus familiaris
GTGPTPGPARGLRTGSRG

SEQ ID NO: 8947 - skipped

SEQ ID NO: 8948 - protein, 17 aa, Canis lupus familiaris
GTGSLRRCSSPTMASLP

SEQ ID NO: 8949 - protein, 16 aa, Canis lupus familiaris
GTIQVSRIGHISSLQS

SEQ ID NO: 8950 - protein, 60 aa, Canis lupus familiaris
GTKCQSPRRRLRQKTWRPRWRQRRQPCRRRSRMTRLPCWLTSSIVPLMTTSHHRPQSLIP

SEQ ID NO: 8951 - protein, 40 aa, Canis lupus familiaris
GTLGANKTPEFIARSLHASRSTFARLREGWSRQSQVAKTN

SEQ ID NO: 8952 - protein, 13 aa, Canis lupus familiaris
GTLPFSTWTPQGL

SEQ ID NO: 8953 - protein, 15 aa, Canis lupus familiaris
GTPCLPGFFGKPLEP

SEQ ID NO: 8954 - protein, 21 aa, Canis lupus familiaris
GTPFLEAVGAPELLREARKMA

SEQ ID NO: 8955 - protein, 9 aa, Canis lupus familiaris
GTPHSKEPL

SEQ ID NO: 8956 - skipped

SEQ ID NO: 8957 - protein, 39 aa, Canis lupus familiaris
GTPRPSWWPLWGQLLTATTRASPPCALPTGPRTSRTSPG

SEQ ID NO: 8958 - protein, 36 aa, Canis lupus familiaris
GTPSARSKEASTVPAIPAASRAAATASSWPSAATPP

SEQ ID NO: 8959 - skipped

SEQ ID NO: 8960 - protein, 22 aa, Canis lupus familiaris
GTQGPCSCCPGSRPQASRAAGS

SEQ ID NO: 8961 - protein, 48 aa, Canis lupus familiaris
GTRAGKDRKEPQGQCGAVGPARRELGTAVGQVVLGPGRIPERELLAPR

SEQ ID NO: 8962 - protein, 60 aa, Canis lupus familiaris
GTRARSGSGGCSSPRHRPTSWSGASGSSGTCRRPSASTWPASSASRPRRSRSGSRTTATR

SEQ ID NO: 8963 - protein, 41 aa, Canis lupus familiaris
GTRAWRRAAAVAAAAAAAASSTAGSPCPLPRPPSTWRTSTT

SEQ ID NO: 8964 - protein, 89 aa, Canis lupus familiaris
GTRCRCSSVPPCSVASWHRVCSCARWHPASPSAWSTWSGWAAASWTRCPRPCETAVPTWPSTPACGGPSAPWSRPPAPSWRVTPSRCST

SEQ ID NO: 8965 - protein, 83 aa, Canis lupus familiaris
GTRLPAAGPHLPPRTRGGPAAAGTGAGVGPGCAEAPALRPGHCAPTHSLPRVPGPATGRASGAPGAVVCQADAVRAAGSPRHR

SEQ ID NO: 8966 - protein, 59 aa, Canis lupus familiaris
GTRPRRTTTGGATAARTSAASRRARARPARRPRTPAAPRSRPGCPALCSASCSWRPTTS

SEQ ID NO: 8967 - protein, 47 aa, Canis lupus familiaris
GTRRAGPCWPWPPTCTSTTPGASTSSTGWRCITPRPRRWLAGTTLRR

SEQ ID NO: 8968 - protein, 43 aa, Canis lupus familiaris
GTRRQRTQPFSLSLRRHLLMPCGQQQVPLSPLLRMHPWQPMRR

SEQ ID NO: 8969 - protein, 35 aa, Canis lupus familiaris
GTRRRPGARLPCCIAHVHGAHAREPWADVPSCQRV

SEQ ID NO: 8970 - protein, 25 aa, Canis lupus familiaris
GTRRRSWRSSQPGPASVTCVAFRAT

SEQ ID NO: 8971 - protein, 34 aa, Canis lupus familiaris
GTRSSRLCPGPKGQPASREAGPLPALVHGDHRAL

SEQ ID NO: 8972 - protein, 47 aa, Canis lupus familiaris
GTRTRSSPTDLSSCCRPASLKTTLIGGGGGAWSVTARSTSAVRNSSL

SEQ ID NO: 8973 - protein, 38 aa, Canis lupus familiaris
GTSCRTSPWTSPTSRRRWSCPGRGAAWGPATWCRRPGA

SEQ ID NO: 8974 - protein, 89 aa, Canis lupus familiaris
GTSPAAPPPAAGWTQPRCWALRCAHASTRCHCSSPSCARRSPRSASRSSSSWRTASSPPARRASSVPGPGRARRASPPNQATPRVAQWC

SEQ ID NO: 8975 - protein, 28 aa, Canis lupus familiaris
GTSPQLETLKAITSLIEMDLFSDMFSTS

SEQ ID NO: 8976 - protein, 24 aa, Canis lupus familiaris
GTSSQAVDSMMCWAQSHMEQSRRW

SEQ ID NO: 8977 - protein, 27 aa, Canis lupus familiaris
GTSSRSSGAPSTTSECPGRTGGTACGS

SEQ ID NO: 8978 - protein, 42 aa, Canis lupus familiaris
GTTRCGPGRRPVVLPTRQGTRVPRRRPGLSSPSGHSGLGARV

SEQ ID NO: 8979 - protein, 28 aa, Canis lupus familiaris
GTTSEVPATSSSPTGTWTPGQGVGSGVT

SEQ ID NO: 8980 - protein, 41 aa, Canis lupus familiaris
GTTVGLLRTAATRTSLPCTPSWLCFPAPWLPRMPPFASTTL

SEQ ID NO: 8981 - protein, 18 aa, Canis lupus familiaris
GTVSDSTRGSSGWLNSRP

SEQ ID NO: 8982 - protein, 8 aa, Canis lupus familiaris
GTWEAGSR

SEQ ID NO: 8983 - protein, 21 aa, Canis lupus familiaris
GTWGLLTLVYQWKCLCGWRLT

SEQ ID NO: 8984 - skipped

SEQ ID NO: 8985 - protein, 22 aa, Canis lupus familiaris
GTWSRDCPSRCAAPTGPSTRAL

SEQ ID NO: 8986 - skipped

SEQ ID NO: 8987 - protein, 16 aa, Canis lupus familiaris
GVAAARSSTSMPWCGS

SEQ ID NO: 8988 - protein, 63 aa, Canis lupus familiaris
GVAAGPGAAAAFRADPGLGGRGRGLLPGRRGARQRAEAAQEAAGEQRGAAGQPAELPGRGGRK

SEQ ID NO: 8989 - protein, 64 aa, Canis lupus familiaris
GVALLTGPGSCPPSLAASPLFSIRRWSTMSCPRPSAIRQTRGRGVHPRVPASPGRKPLRKWPMR

SEQ ID NO: 8990 - protein, 12 aa, Canis lupus familiaris
GVALQRTPLQDQ

SEQ ID NO: 8991 - protein, 48 aa, Canis lupus familiaris
GVCERPAPARRGEAAHRGAGPPGRAALRHIPAAARQPRLCQQNPGQVL

SEQ ID NO: 8992 - protein, 32 aa, Canis lupus familiaris
GVCGSVARTGSRLVLPGDGRLRRREPGRWVLH

SEQ ID NO: 8993 - protein, 49 aa, Canis lupus familiaris
GVEAVAQRSFPPEGQSRQGQGLLRLSKTQPREWFFCFLAVWLGRVTQPL

SEQ ID NO: 8994 - protein, 8 aa, Canis lupus familiaris
GVGACALE

SEQ ID NO: 8995 - protein, 53 aa, Canis lupus familiaris
GVGARVSTSPPRRWSQTWGSLDQSPSRGLGCWSPGVVSLAVTWLRDASQGSRS

SEQ ID NO: 8996 - protein, 31 aa, Canis lupus familiaris
GVGGAVQAPTGMLQPRPVAWLPRFPVLIAEL

SEQ ID NO: 8997 - protein, 86 aa, Canis lupus familiaris
GVGGRTLPRAPQPRLPQGRPRRRAGWSPGSGGRGGAVRRPGRCPEPCIGSHRTAGISRPARIRAGGCGLPRTPPDSPGLPGQVQAE

SEQ ID NO: 8998 - skipped

SEQ ID NO: 8999 - protein, 32 aa, Canis lupus familiaris
GVGSTSWCRNTKSHISSGSVGDTRCQHMLRGS

SEQ ID NO: 9000 - protein, 38 aa, Canis lupus familiaris
GVGSTSWCRNTKSHISSGSVGDTRCQHMLRHLSQGAAL

SEQ ID NO: 9001 - protein, 17 aa, Canis lupus familiaris
GVLAGKGWERGLTTAWL

SEQ ID NO: 9002 - protein, 90 aa, Canis lupus familiaris
GVLCVTGCCRATLCWRPLEMPRPSGMITPAGLGSTWMYSLTSRVLPWVATSSVTSWKSPEWCTRTTGRETSTSSTSCWKGARRRCCAGWA

SEQ ID NO: 9003 - protein, 8 aa, Canis lupus familiaris
GVLPTSHG

SEQ ID NO: 9004 - protein, 26 aa, Canis lupus familiaris
GVLRSRAASSRPATSSSQSTASPWWT

SEQ ID NO: 9005 - protein, 37 aa, Canis lupus familiaris
GVLSFFQGGRKVRTRSARNLAGRGPWYRVLLLAGSAV

SEQ ID NO: 9006 - protein, 16 aa, Canis lupus familiaris
GVPARHMCPRLQRPLL

SEQ ID NO: 9007 - skipped

SEQ ID NO: 9008 - protein, 22 aa, Canis lupus familiaris
GVPQPSPGHTHGPRPDLEVAWP

SEQ ID NO: 9009 - protein, 44 aa, Canis lupus familiaris
GVPSGLGEAALVGGVSTGVVEAAVFQLLLLDLFPRGQEGAMGVA

SEQ ID NO: 9010 - protein, 10 aa, Canis lupus familiaris
GVPSSACPWH

SEQ ID NO: 9011 - protein, 25 aa, Canis lupus familiaris
GVPSSPCWSWPQVTTRASRSCPASS

SEQ ID NO: 9012 - protein, 92 aa, Canis lupus familiaris
GVPVGPLGSQGTALIGSLAGPLGIGPENGPISGEGKRPPPVILWKLDTYVMQKAIWMRGSPMMTSTHPLLSQPAKPRAPTAPSMGTVKQNSP

SEQ ID NO: 9013 - protein, 49 aa, Canis lupus familiaris
GVPWLLSPSIRKRRGLSPLGRRWPCPQTQQSPCPPTPTRRSLAPTAAGS

SEQ ID NO: 9014 - protein, 36 aa, Canis lupus familiaris
GVQGLRRPPVALAEGAGLSSKATCCSPLRVGRAGPR

SEQ ID NO: 9015 - protein, 10 aa, Canis lupus familiaris
GVQGTRSAGF

SEQ ID NO: 9016 - protein, 24 aa, Canis lupus familiaris
GVQVHRARRQWPQGQWQVEPKVMH

SEQ ID NO: 9017 - protein, 22 aa, Canis lupus familiaris
GVRAAKIRAARRRRSGRPGWGV

SEQ ID NO: 9018 - protein, 89 aa, Canis lupus familiaris
GVRILSSPSGCGCAVGAWRSCPAAGWATSSGNGTPTTSLRAMPSPISGIPSALQRCGWMNTSSITTRPGPQPSGRPLAAWPRGLSRGRR

SEQ ID NO: 9019 - skipped

SEQ ID NO: 9020 - protein, 58 aa, Canis lupus familiaris
GVRPRTQAGTGLRPRGSRAGPEEALRTRRPRGCSSMCPRTGPSTPGPSTRLTCSPPSP

SEQ ID NO: 9021 - protein, 43 aa, Canis lupus familiaris
GVSGPREGGWAQVGVGWTHRQASVSPKGPCRRMQSMSSACRNQ

SEQ ID NO: 9022 - skipped

SEQ ID NO: 9023 - protein, 23 aa, Canis lupus familiaris
GVSGSTQLSEADAPLQYQRTGSG

SEQ ID NO: 9024 - protein, 34 aa, Canis lupus familiaris
GVSRRAAATRPSGSTVGPRAPAMCGTRCLPAPSC

SEQ ID NO: 9025 - protein, 10 aa, Canis lupus familiaris
GVSSAPPSRR

SEQ ID NO: 9026 - protein, 43 aa, Canis lupus familiaris
GVSTTEGPCTGMGGKEGRGLVPHPPTPLPAGPSTLRVRPGATA

SEQ ID NO: 9027 - protein, 32 aa, Canis lupus familiaris
GVTITMTTMAGPMVAVGPARHTQPCLLSPKRS

SEQ ID NO: 9028 - protein, 91 aa, Canis lupus familiaris
GVTPLGARTGRFPAAGCGAAATSKPWGMRRAETQTAAPRRLPKPWPGASPPAAPPVWTRPGSTAVSRPGSIPGAPSLATAVPSPPDSSVRS

SEQ ID NO: 9029 - skipped

SEQ ID NO: 9030 - protein, 50 aa, Canis lupus familiaris
GVTSALASSPSPRPPSARASEIGAVTSARRLPREATSLASSVTTGQVVLP

SEQ ID NO: 9031 - protein, 32 aa, Canis lupus familiaris
GVVSLFGWPRPQGRPAGASPHCHSLCASPDWH

SEQ ID NO: 9032 - protein, 16 aa, Canis lupus familiaris
GVVSPPAQSEGRDARR

SEQ ID NO: 9033 - protein, 76 aa, Canis lupus familiaris
GVWGAGPRAGAGRARRAAVGERRAAARGRPEGEGEASRAPGGNHKQLAGGRRGFSFSAHPPPAAGARRGRGEPGAP

SEQ ID NO: 9034 - protein, 13 aa, Canis lupus familiaris
GVWPAQWQRLPTW

SEQ ID NO: 9035 - protein, 98 aa, Canis lupus familiaris
GVWRRLGALLPRGGGGQPRDGHRQTPQGAGCRRASDRGPGGSRGTFSGPTSSGRWKRKFPPRGARHGQPDARPEEGLGSCWPAPPATVGLPAFSFRFH

SEQ ID NO: 9036 - protein, 33 aa, Canis lupus familiaris
GWAPGRPLGAGARSSSGASFSAPCAQPLPVPSR

SEQ ID NO: 9037-9038 - skipped (2 entries)

SEQ ID NO: 9039 - protein, 24 aa, Canis lupus familiaris
GWGCPHLPFLQLTKVSASWRALGI

SEQ ID NO: 9040 - protein, 30 aa, Canis lupus familiaris
GWGFLVPASVPTSTCATGLCGSNSTATKPR

SEQ ID NO: 9041 - protein, 26 aa, Canis lupus familiaris
GWGGLCRRPRGCSSPGPWPGSRGSLC

SEQ ID NO: 9042 - protein, 8 aa, Canis lupus familiaris
GWGGTRLN

SEQ ID NO: 9043 - protein, 91 aa, Canis lupus familiaris
GWGQLSAPRPPGHPRASPQSPVPALHGLPGTHPRPGAAVRGGTLCLPGSSGSRGGLDAAQAPTSRGWSLICGPRLASSRNSARRPGARTNG

SEQ ID NO: 9044 - skipped

SEQ ID NO: 9045 - protein, 13 aa, Canis lupus familiaris
GWLRTPARASTTS

SEQ ID NO: 9046 - protein, 60 aa, Canis lupus familiaris
GWPCWPPFCRRVQKKTVPMSSCCHIWKKSLKKTQRLGSQDWMYPRCCPLTSAATSAMRGL

SEQ ID NO: 9047 - protein, 72 aa, Canis lupus familiaris
GWPGRARARGPPALVQRGSLLSATSTWTPTSWSPSPARHSSLCRPLRVRVPTCAPSALQDPPPRPGDACSRN

SEQ ID NO: 9048 - protein, 70 aa, Canis lupus familiaris
GWPGRARGPPALVQRGSLLSATSTWTPTSWSPSPARHSSLCRPLRVRVPTCAPSALQDPPPRPGDACSRN

SEQ ID NO: 9049 - protein, 16 aa, Canis lupus familiaris
GWRAAGPCPSMGSWGG

SEQ ID NO: 9050 - protein, 59 aa, Canis lupus familiaris
GWRCSCWAWQGLGVPCVGGDGGPSLRRVATLVLAPSGGEGLWAWAAEVAWGLGRLSLGS

SEQ ID NO: 9051 - protein, 36 aa, Canis lupus familiaris
GWRGGAVERLDVAWTPSWAGRRPPASFPSYPRARSA

SEQ ID NO: 9052 - protein, 28 aa, Canis lupus familiaris
GWRRPPQPRTPAQPTEPATASPATRTAS

SEQ ID NO: 9053 - protein, 13 aa, Canis lupus familiaris
GWSLLHDQPDPGA

SEQ ID NO: 9054 - protein, 10 aa, Canis lupus familiaris
GWTAQWPRCC

SEQ ID NO: 9055 - skipped

SEQ ID NO: 9056 - protein, 8 aa, Canis lupus familiaris
GWTCSSVT

SEQ ID NO: 9057 - protein, 46 aa, Canis lupus familiaris
GWTQRPPATSRNTAWAWPRGPSTSPSWAAWRISASTARGRGSGKPR

SEQ ID NO: 9058 - protein, 14 aa, Canis lupus familiaris
GWVFYRSSLPGRSQ

SEQ ID NO: 9059 - protein, 9 aa, Canis lupus familiaris
GWWSSIWRP

SEQ ID NO: 9060 - protein, 58 aa, Canis lupus familiaris
GWYPSLRAPRPSHLPPLWWAGPALPTPKRTPSRRRGYCGAPQAPPRKCSGWWARVVSP

SEQ ID NO: 9061 - protein, 13 aa, Canis lupus familiaris
GYDEPADPDGGIP

SEQ ID NO: 9062 - protein, 12 aa, Canis lupus familiaris
GYGAVRGQARTA

SEQ ID NO: 9063 - protein, 11 aa, Canis lupus familiaris
GYLWEAAAGGR

SEQ ID NO: 9064 - protein, 30 aa, Canis lupus familiaris
GYPASPAPTARASSTSPRASLLWPDSRQNS

SEQ ID NO: 9065 - skipped

SEQ ID NO: 9066 - protein, 30 aa, Canis lupus familiaris
VAVGDRVRPAAAPPPLPTCTATELSLPKTE

SEQ ID NO: 9067 - protein, 19 aa, Canis lupus familiaris
VCEVPSNLGHGSRNGHGRQ

SEQ ID NO: 9068 - protein, 56 aa, Canis lupus familiaris
VCICIPAERRSPAVWGGYLLRHLDLPWGTYQGLFLLPRGGGGADPPLRDLPGDQCQ

SEQ ID NO: 9069 - protein, 13 aa, Canis lupus familiaris
VCPMERHPAAAEE

SEQ ID NO: 9070 - protein, 27 aa, Canis lupus familiaris
VEWGCRPQPCGLEPGWRGPHAAAARLS

SEQ ID NO: 9071 - protein, 38 aa, Canis lupus familiaris
VGGLGRGAGPRSCCRRRPACRPQCPRELDQVSEPGPVC

SEQ ID NO: 9072 - protein, 44 aa, Canis lupus familiaris
VGGLGRGAGPRSCCRRSLLLCRRPACRPQCPRELDQVSEPGPVC

SEQ ID NO: 9073 - protein, 95 aa, Canis lupus familiaris
VGGRTGLRGRPAMLPSGPGGAPSLWRCPYWHSPASTPSAWHAFATTPPGPLTWHLGEPACPVSEAGGAGRGFRGGGGRPCSRMPQHPHHLHLSHA

SEQ ID NO: 9074 - skipped

SEQ ID NO: 9075 - protein, 91 aa, Canis lupus familiaris
VGNHRRARGPPVRMGCVSAGQGVVQRGRQPPQPRRLIVVPHGHPRGGGADQLWAPRPPVGHALGGAGLGPGRNQQEQSQRKFLVHSGASHL

SEQ ID NO: 9076 - protein, 8 aa, Canis lupus familiaris
VGRGPPPF

SEQ ID NO: 9077 - protein, 38 aa, Canis lupus familiaris
VGVGVSRLRSTAGRDRISGGTDPAAEERDGSPGRKFCQ

SEQ ID NO: 9078 - protein, 9 aa, Canis lupus familiaris
VLCFLHNSL

SEQ ID NO: 9079 - protein, 23 aa, Canis lupus familiaris
VLHPSVDRSHPVLDCVWDPVLHE

SEQ ID NO: 9080 - skipped

SEQ ID NO: 9081 - protein, 10 aa, Canis lupus familiaris
VLQTHSHRDL

SEQ ID NO: 9082 - protein, 39 aa, Canis lupus familiaris
VPLPPPPLQRPQGRVGRPHPPCHLLRCGHRPLQCLLLGR

SEQ ID NO: 9083 - protein, 95 aa, Canis lupus familiaris
VPPAAETHLLCRLHDPAVLLQLPGVHRMRAPGLHGLRPLRGHLPPPALPSHHDHGALRPAGGLLLRQRLLHLYDQGVLCLQGHVLWLQRPEPLLL

SEQ ID NO: 9084 - protein, 14 aa, Canis lupus familiaris
VPRAPSPQGRDSVA

SEQ ID NO: 9085 - protein, 31 aa, Canis lupus familiaris
VQCLSLLLCGNQEAGPGQSSCGLSPVSLGNS

SEQ ID NO: 9086 - protein, 39 aa, Canis lupus familiaris
VQMDACRRTESAGQVCVRVFTSGCHSPKNLLRSPDSSPI

SEQ ID NO: 9087 - protein, 30 aa, Canis lupus familiaris
VQPRDVRGWPFYSSQLLTVHHRAWDKWPAD

SEQ ID NO: 9088 - protein, 19 aa, Canis lupus familiaris
VQSDSKMLWSFDEAIDDIG

SEQ ID NO: 9089 - protein, 34 aa, Canis lupus familiaris
VRARAPLQRLLQRPGVPAAAPEDAGDKSLCQTSA

SEQ ID NO: 9090 - protein, 44 aa, Canis lupus familiaris
VRGLPSGVPRVQHAPHPGRQKVGAGRTQGRAVLDSEQRRRPHRE

SEQ ID NO: 9091 - protein, 8 aa, Canis lupus familiaris
VRLRNLSH

SEQ ID NO: 9092 - protein, 41 aa, Canis lupus familiaris
VRPEHWLGPELCPCQPLHRSWRQQDPRTRAAALAPAHSRAV

SEQ ID NO: 9093 - protein, 59 aa, Canis lupus familiaris
VRPGLSARLGRDRRQVRHPLRDPVPLPAHHRRGLAGQHHAGEDLHHHQRHEERPQHLHL

SEQ ID NO: 9094 - protein, 60 aa, Canis lupus familiaris
VRVGGRLPAPRAALRRSWLPHLPGWRPIADQGATGKRKEQPYLWTPSPEEEKGSACKFKG

SEQ ID NO: 9095 - skipped

SEQ ID NO: 9096 - protein, 26 aa, Canis lupus familiaris
VSLCCHWARLPIPCAFAPRKTSPARG

SEQ ID NO: 9097 - protein, 29 aa, Canis lupus familiaris
VTGHERQGVGSPLQGKATPKETGLWEKGV

SEQ ID NO: 9098 - skipped

SEQ ID NO: 9099 - protein, 22 aa, Canis lupus familiaris
VYPCSNTASLHVSTTLLWPQCY

SEQ ID NO: 9100 - protein, 31 aa, Canis lupus familiaris
VYVDAKKFTGPLPPEGPKGTEGWVQGPTEGL

SEQ ID NO: 9101 - protein, 81 aa, Canis lupus familiaris
AAASRGSPPARARARARARLSVGGARPRRRRRGRGRGRGRGRGRRGRAGGRLGSGEPRPGLAGLPGATRRRGQIHPQKRTS

SEQ ID NO: 9102 - protein, 40 aa, Canis lupus familiaris
AALRQRCQRVWPAERGLQPHLFQQAGQLPLCLLQRLRALP

SEQ ID NO: 9103 - protein, 10 aa, Canis lupus familiaris
AAPRSPHRCR

SEQ ID NO: 9104 - protein, 35 aa, Canis lupus familiaris
AGAQAQPHWPPRFPPRRGLSGPGLSAPPMGGSGPF

SEQ ID NO: 9105 - protein, 60 aa, Canis lupus familiaris
AGARAGVGPLVPWSPAVRYLRATPRALFGSMPPASAGRASCFRIAFEGSVLSLLYRRQYF

SEQ ID NO: 9106 - protein, 17 aa, Canis lupus familiaris
AGFCRGSHSCRAQPRTL

SEQ ID NO: 9107 - protein, 67 aa, Canis lupus familiaris
AGGERDPRSQTPDALAAGEGASCALDARARRGGPVAGREEAPRAGAKGGPCRPATAPGRAPGTRAPT

SEQ ID NO: 9108 - protein, 80 aa, Canis lupus familiaris
AHPQVHCPSVTHPAQPAAPEGPGPHLPHRGLPCVPAAGGRTAGIREVAAGPWGGAHRDCLGSEVACPRLPPEQPADPGPH

SEQ ID NO: 9109 - protein, 43 aa, Canis lupus familiaris
AHTRPLLGAAAAAAPATRGQAPGRPGRAPGPGGPGAADRVVPR

SEQ ID NO: 9110 - protein, 38 aa, Canis lupus familiaris
ALPEEATRPAAPTALGPIPEIGCIILPTPAATCVPEDS

SEQ ID NO: 9111 - protein, 14 aa, Canis lupus familiaris
ALSGSPSLRESAAV

SEQ ID NO: 9112 - protein, 74 aa, Canis lupus familiaris
APPQPPGGKPGPRGLKFRRLQKLYCPGHAGFQPALRPGKQRPPLYHQQGQGPEADGPQRASRPLCQAASAARSQ

SEQ ID NO: 9113 - protein, 33 aa, Canis lupus familiaris
ARGCGARRESEGGREPRRHRDSARQKEEGSAVV

SEQ ID NO: 9114 - protein, 8 aa, Canis lupus familiaris
DAGARSGD

SEQ ID NO: 9115 - skipped

SEQ ID NO: 9116 - protein, 44 aa, Canis lupus familiaris
DVPVQVPQGAPRALPLLCPPLGSRRVRHGACCQDQGRVDHDFGQ

SEQ ID NO: 9117 - protein, 46 aa, Canis lupus familiaris
EPKPARGPKVFRNYGDFPSGTPDLRLSPRRAQPNPLPAFITLDPSK

SEQ ID NO: 9118 - protein, 73 aa, Canis lupus familiaris
ERHGAKVFSCRGCRRPRPFKGAQDHGGEYGRPQRLQPAGPQAPWGQRVCIMATGFGGLRKAHTAGSAHCYPMV

SEQ ID NO: 9119 - protein, 14 aa, Canis lupus familiaris
ESNCAFVLQMPNSL

SEQ ID NO: 9120 - protein, 49 aa, Canis lupus familiaris
GAALTSSATSGSGWTPRPPTFLSPWPSPAIPLLTPRMSWCSSLTTWPNS

SEQ ID NO: 9121 - protein, 31 aa, Canis lupus familiaris
GAEEAAARRAAGPERRCNPSRGPRPLPAGPS

SEQ ID NO: 9122 - protein, 89 aa, Canis lupus familiaris
GAEGGQGGGETWGQVPCLSSPYPCLLFLLLLVGGLAEGGFPSSLCPLPPTQEAPLPLWPWDHPAQRCRPRGPLTLATAPSPPGQHRHSL

SEQ ID NO: 9123 - protein, 20 aa, Canis lupus familiaris
GAFWKPQSQGISSCLMMGCW

SEQ ID NO: 9124 - protein, 57 aa, Canis lupus familiaris
GAGAGARGARAAGAAAGARARARAAAPARPTPCCTLGTWRRCRGCRRATSCSRWCTG

SEQ ID NO: 9125 - protein, 68 aa, Canis lupus familiaris
GAGAHGRSGAPALGARAEGEEAAAAAAEVEAASWKGDRVQDGVESWRFPGLRWKLERCFYLQALRMRS

SEQ ID NO: 9126 - protein, 33 aa, Canis lupus familiaris
GAGAQVIIWPDTQHLPHMPPLRVPPSTPLRIMS

SEQ ID NO: 9127 - protein, 28 aa, Canis lupus familiaris
GAGGARFEPSCSPCGALAAAAAPAPPPS

SEQ ID NO: 9128 - protein, 31 aa, Canis lupus familiaris
GAGGRAGRPLRGRAGSAGGQGVPRLQLPRGV

SEQ ID NO: 9129 - protein, 53 aa, Canis lupus familiaris
GAGITSLSGPMPPEPSGAGPRRQPLTGVGSRASPARRRGWLEPRRRPVALSAA

SEQ ID NO: 9130 - protein, 52 aa, Canis lupus familiaris
GAGLCRSLSTLRELSPRARPLVLRRTGCVAPGPPGLSPWPAGLPWAAPGRRP

SEQ ID NO: 9131 - protein, 54 aa, Canis lupus familiaris
GAGLHLTALPPGGQVRGLRMAGQVIPRRFLSKGICSAGGTKQKGAFCSKKEKDL

SEQ ID NO: 9132 - protein, 47 aa, Canis lupus familiaris
GAGNPSWLPRKVDLCPSAPTAWAFRPRVQQMGPASPWTGLTSGFPAP

SEQ ID NO: 9133 - protein, 58 aa, Canis lupus familiaris
GAGSARRPPGRWSPTRRRAPRPRIQHLSPAHWPLPAHQGCALCPLVKEWSLIPYRQRK

SEQ ID NO: 9134 - skipped

SEQ ID NO: 9135 - protein, 96 aa, Canis lupus familiaris
GAGTRGAALPPRRGAQLPAGGGPRGSPQPGRGGEGRGGGATGQRPGERGCRVPLAKLASLHRKLSGKIDFSFFARKTKKSLMWTPSVNQSSGCSSA

SEQ ID NO: 9136 - protein, 22 aa, Canis lupus familiaris
GAKACSGTESFPELWGLPFWHS

SEQ ID NO: 9137 - protein, 38 aa, Canis lupus familiaris
GAKKKHSNKTTPRFSPMEMPACMPITSSTPSTPPRQAP

SEQ ID NO: 9138 - protein, 25 aa, Canis lupus familiaris
GAKPNFALRRKSQNHIRVLLSLPCP

SEQ ID NO: 9139 - protein, 48 aa, Canis lupus familiaris
GALAPSSSWAGATLGRPGWAVHLTSRSSAEPTQLPTPAASTSARWPWT

SEQ ID NO: 9140 - protein, 29 aa, Canis lupus familiaris
GALCPPPPCHCPPPRSARKKAARKTSSSS

SEQ ID NO: 9141 - protein, 82 aa, Canis lupus familiaris
GALGTWHWTRHAARAPSDPGNTPWGSPSPGIRRAGPRGGPPQSRPGGAHPRAAPTAHGPQPWARTVPGTRGSQKPLGQWRPD

SEQ ID NO: 9142 - protein, 24 aa, Canis lupus familiaris
GALNLVLLSSQHRVWGWPRLWRLC

SEQ ID NO: 9143 - protein, 56 aa, Canis lupus familiaris
GAMEETAVVAGATVETEVAATEETEVGAAMEETEEAMEAKWEEETTTEMISATDHT

SEQ ID NO: 9144 - protein, 19 aa, Canis lupus familiaris
GAMGAPGPPPRAASRPDLP

SEQ ID NO: 9145 - protein, 33 aa, Canis lupus familiaris
GAPASSSGLASLWWGLSPQEPILAPPATARGAP

SEQ ID NO: 9146 - protein, 12 aa, Canis lupus familiaris
GAPRALQAGGFP

SEQ ID NO: 9147 - protein, 81 aa, Canis lupus familiaris
GAPRARPRGWSPSRCRKMPSRSARILLSCPTSTSSRSTPVSSCPEASPPACRARSTARFPFPRKSWTSSPAPSVPSTCSSL

SEQ ID NO: 9148 - protein, 57 aa, Canis lupus familiaris
GAQPQLLQLLQPPGAACPLTTPLSTPTTAANLPRSATSTTQSWRSMSRPVTSSRPTS

SEQ ID NO: 9149 - protein, 15 aa, Canis lupus familiaris
GAREHGRPPGLWGEP

SEQ ID NO: 9150 - protein, 48 aa, Canis lupus familiaris
GARGGASVPSLPLLGCAPRTPRPTQTRGPSPPPAAPLERAPRSDPPSR

SEQ ID NO: 9151 - protein, 29 aa, Canis lupus familiaris
GARKPRPEPRELANSWRGLGHPRPPQSHL

SEQ ID NO: 9152 - skipped

SEQ ID NO: 9153 - protein, 62 aa, Canis lupus familiaris
GARRRRATRSAKWGWRRATRSKSPWRSGPGRTKTGPCCWRAAAATRGCGGPRRASGSWPRPP

SEQ ID NO: 9154 - protein, 70 aa, Canis lupus familiaris
GASEPWAAWAPGACATWASGGPGWPPGAACLASGTEWGPSPDPRPASPPSPSTRACWSHSSWRSTRLCRG

SEQ ID NO: 9155 - protein, 29 aa, Canis lupus familiaris
GASGPRGHPPTSFPTLSRPRSRSSRRRSR

SEQ ID NO: 9156 - protein, 19 aa, Canis lupus familiaris
GASPSALSFCHSSSATGGA

SEQ ID NO: 9157 - protein, 56 aa, Canis lupus familiaris
GASRAGQFPVWRRTSRGMSPQWKSGNACTPLRCPSCSPATFLTVLNGWHRSGLRAR

SEQ ID NO: 9158 - protein, 38 aa, Canis lupus familiaris
GATGTQRTPCHHRGRPSTSPPSLSGAASTSTAGPRRPC

SEQ ID NO: 9159 - protein, 29 aa, Canis lupus familiaris
GAVLFLSQVRNPTTVIGTAVGGNSPARTN

SEQ ID NO: 9160 - protein, 28 aa, Canis lupus familiaris
GAVQAPTGMLQPRPVAWLPRFPVLIAEL

SEQ ID NO: 9161 - protein, 36 aa, Canis lupus familiaris
GAVRWLSEGQHHGSAPRLPGHPRRPAVPGAERRERG

SEQ ID NO: 9162 - protein, 72 aa, Canis lupus familiaris
GAWAGTVTWPCPPWSATTSTTTTTWRPPSRRTTAATPAAGAAGARAPRGSTPSTNLCSSRVAPRRMCKRRRS

SEQ ID NO: 9163 - protein, 99 aa, Canis lupus familiaris
GAWRARVQPASTRPATGSSRVPSTCTARPLSRTSPGCVPATPPRRRAPRSRGTRTWRPRVTSGSTPGCEAQGRTESEAARPTPATRPWSWRRSFTTTAT

SEQ ID NO: 9164 - skipped

SEQ ID NO: 9165 - protein, 12 aa, Canis lupus familiaris
GCPCPSRCKPRC

SEQ ID NO: 9166 - protein, 26 aa, Canis lupus familiaris
GCPQLPVPSSFSLPSLQSCAQNGSRL

SEQ ID NO: 9167 - protein, 54 aa, Canis lupus familiaris
GCRAAPHRPSPRRPGSRSQNGRAGHPKTLPQQGHLQCRRNQAKRGLLFKKGKRP

SEQ ID NO: 9168 - protein, 22 aa, Canis lupus familiaris
GCSKKPSQMQMTSACSSLWIWT

SEQ ID NO: 9169 - protein, 24 aa, Canis lupus familiaris
GCSQPPLSLAALAAPNSASPASSL

SEQ ID NO: 9170 - protein, 16 aa, Canis lupus familiaris
GCVPLPPRLRPLLTDL

SEQ ID NO: 9171-9172 - skipped (2 entries)

SEQ ID NO: 9173 - protein, 30 aa, Canis lupus familiaris
GDRSSCLGKPQQLSEHLLESKMLMDWSRSL

SEQ ID NO: 9174 - protein, 29 aa, Canis lupus familiaris
GDRSSCLGKPQQLSEHLLESKMLMVPTSF

SEQ ID NO: 9175 - protein, 38 aa, Canis lupus familiaris
GEEGEMAQNVGTLSPSRRAAGTPPGMRRLTTSPPTRSS

SEQ ID NO: 9176 - skipped

SEQ ID NO: 9177 - protein, 57 aa, Canis lupus familiaris
GEHSPSWASRCWWPSRAASSPSSSEAGTSCGDRAERPVSLASWRRAGAWWTAPSSTP

SEQ ID NO: 9178 - protein, 32 aa, Canis lupus familiaris
GEISGKRPPGKMTKSGRALSNSHRSKRRKPSP

SEQ ID NO: 9179 - protein, 13 aa, Canis lupus familiaris
GELRHPSRRLLVP

SEQ ID NO: 9180 - protein, 58 aa, Canis lupus familiaris
GEMMISLGMGMQRTPLMCTAPSLKLFWTTLRYTTVLNPWRHYIQNPIAILALTCPSLR

SEQ ID NO: 9181 - skipped

SEQ ID NO: 9182 - protein, 61 aa, Canis lupus familiaris
GEPADRHQQVHGQPQGAFRREWQGQRHRRPGRGDRQLRLCNAPPDGEQEKHCHVSEERNAA

SEQ ID NO: 9183 - skipped

SEQ ID NO: 9184 - protein, 9 aa, Canis lupus familiaris
GFTRGRDPC

SEQ ID NO: 9185 - protein, 69 aa, Canis lupus familiaris
GGAGAEGPPRGVGGRPPPPHLLPPGAGRWPRMCASRGHRWLRGGRAARTCAGAGPGPQRLARCPLVMYL

SEQ ID NO: 9186 - skipped

SEQ ID NO: 9187 - protein, 84 aa, Canis lupus familiaris
GGGAARPGSLTVTRGAAPSGAAPARRGPRTVSRGRRSRPLGLERQACRRPAAADTGRGRGGQRTASAEAGRCCNLRPRLRTAPS

SEQ ID NO: 9188 - protein, 54 aa, Canis lupus familiaris
GGGGAATPVFQFRNHWYECPPSRRGPGAATTLGLWSFGGSKAGPAKLSGRARVL

SEQ ID NO: 9189 - protein, 13 aa, Canis lupus familiaris
GGGGEGDRTLSTP

SEQ ID NO: 9190 - protein, 84 aa, Canis lupus familiaris
GGGGLKIAQQPGAEATAGANKRGAQRPSLESDPCNTQEASGSARLAPAPGGRGKEDSRARSRAPPPPHTPALSPSSGATTRAPP

SEQ ID NO: 9191 - protein, 19 aa, Canis lupus familiaris
GGGGWKRIGPLPPAFSLAV

SEQ ID NO: 9192-9193 - skipped (2 entries)

SEQ ID NO: 9194 - protein, 24 aa, Canis lupus familiaris
GGGTGRGRSPGPLVPGSSLPACNP

SEQ ID NO: 9195 - protein, 50 aa, Canis lupus familiaris
GGGTGTAPLAPQVSPETGTFGTGTFGPTNGRIWPFLRRRRRRRSPVTSSC

SEQ ID NO: 9196 - protein, 10 aa, Canis lupus familiaris
GGNKQTSPWT

SEQ ID NO: 9197 - protein, 26 aa, Canis lupus familiaris
GGRGRRPGRLPRRLPRDPPGRRRAGL

SEQ ID NO: 9198 - protein, 86 aa, Canis lupus familiaris
GGRQPGLPAGPRPRPRPRPAQRRRRPTPKTAARTRARTRARARATGTRGRPPGVGRAPARPGGTSRSDSATRPNSSPEKNKLAPCI

SEQ ID NO: 9199 - protein, 78 aa, Canis lupus familiaris
GGRRKGSALPDPGRPGRGGRGVVRPGRARPTRGTSRRAGGSAQGGRQRRSLPTCDGPGKGSGNAGSDLRASSKPQGPR

SEQ ID NO: 9200 - skipped

SEQ ID NO: 9201 - protein, 33 aa, Canis lupus familiaris
GGSNYPAQVVSPALLSPLTWLPGLWRTPGQAPS

SEQ ID NO: 9202 - protein, 13 aa, Canis lupus familiaris
GGSWILGRELNSS

SEQ ID NO: 9203 - protein, 9 aa, Canis lupus familiaris
GGTLLSWDT

SEQ ID NO: 9204 - skipped

SEQ ID NO: 9205 - protein, 44 aa, Canis lupus familiaris
GHCPLHTSLPTAGHCPPVPTAGSLPTAHLAAPLDPWYKGSPQCA

SEQ ID NO: 9206 - protein, 98 aa, Canis lupus familiaris
GHGGGAAPPAGGLLRDSRACRERSSHSRGDTGSRTQWAPAPSPASRAHHRHGGHCSGTGRGSAPGLHLHPVLRWGPPLGTQCRALGWNAARHLLPQGP

SEQ ID NO: 9207 - protein, 29 aa, Canis lupus familiaris
GHGGPECSRRLRGRLRARAEFLQHALRAL

SEQ ID NO: 9208 - protein, 30 aa, Canis lupus familiaris
GHPEPGSFLCGGGHPGACHLSGRVEMHVHP

SEQ ID NO: 9209 - protein, 57 aa, Canis lupus familiaris
GHVLRLPLCPHHSLWGHQGAAGRPGKGECHPPTPSQSLRDQVPTDQRLWRGARLLPV

SEQ ID NO: 9210 - protein, 41 aa, Canis lupus familiaris
GIALRMATIFVGTWAHWSSGQLPFHKATSNTVLSIQLEWEN

SEQ ID NO: 9211 - protein, 11 aa, Canis lupus familiaris
GKFLEKGPPVK

SEQ ID NO: 9212 - protein, 13 aa, Canis lupus familiaris
GKKWGPWILKSRG

SEQ ID NO: 9213 - protein, 96 aa, Canis lupus familiaris
GLAALAAAPRAAGTTTWCDGAWCCSRWGSCWPWCSTCCRCSGTSRCSPRRSSPPSSRRPGGSRRAAGRRPLWWACCTPASTVTWENHTSLRESGPA

SEQ ID NO: 9214 - skipped

SEQ ID NO: 9215 - protein, 23 aa, Canis lupus familiaris
GLCRRPRGCSSPGPWPGSRGSLC

SEQ ID NO: 9216 - protein, 14 aa, Canis lupus familiaris
GLCSTTAQAPPATH

SEQ ID NO: 9217 - protein, 13 aa, Canis lupus familiaris
GLEGSRCGGCRAS

SEQ ID NO: 9218 - protein, 11 aa, Canis lupus familiaris
GLGNRAPSRES

SEQ ID NO: 9219 - protein, 24 aa, Canis lupus familiaris
GLGSHHCPGQCHQSLQEQVPGDSH

SEQ ID NO: 9220 - skipped

SEQ ID NO: 9221 - protein, 10 aa, Canis lupus familiaris
GLLEGRMPAV

SEQ ID NO: 9222 - protein, 41 aa, Canis lupus familiaris
GLLGRPHLEPDGLRWQETAQQVCRLGRGGERGRQEGQGDHC

SEQ ID NO: 9223 - protein, 15 aa, Canis lupus familiaris
GLPPLLQVWPLCGGA

SEQ ID NO: 9224 - protein, 15 aa, Canis lupus familiaris
GLQGWHSSWSRYKGN

SEQ ID NO: 9225 - protein, 22 aa, Canis lupus familiaris
GLRGPRGPRATIGVAPAHPRLP

SEQ ID NO: 9226 - protein, 35 aa, Canis lupus familiaris
GLRGRAAGVQGCRPPETAVGPSGGGWGLWGGGNAA

SEQ ID NO: 9227 - protein, 22 aa, Canis lupus familiaris
GLRLLGLGSARLLLVCGERAHS

SEQ ID NO: 9228 - protein, 18 aa, Canis lupus familiaris
GLSRSCCSCCSLRGRRVP

SEQ ID NO: 9229 - protein, 27 aa, Canis lupus familiaris
GLTLSGCAAAWSRSGRAAGPAWAALAT

SEQ ID NO: 9230 - protein, 48 aa, Canis lupus familiaris
GLWRRPRWWRGLRWRPRWRLRRRQKWGRLWRRPRRLWRQNGRKKRLQK

SEQ ID NO: 9231 - skipped

SEQ ID NO: 9232 - protein, 51 aa, Canis lupus familiaris
GPAPPRRALRRPPRRPRSPPRPQEPKRPKAPRRRKRPSPRRRPRALRRPKL

SEQ ID NO: 9233 - protein, 38 aa, Canis lupus familiaris
GPARAAAPGARRPAVARNCSTSVPPRPRRRAGPARRTR

SEQ ID NO: 9234 - protein, 24 aa, Canis lupus familiaris
GPARGTTSSTGSAFGTRKPPWSVP

SEQ ID NO: 9235 - skipped

SEQ ID NO: 9236 - protein, 82 aa, Canis lupus familiaris
GPATPPPFGFGVCCFRCGIFTGGFWARLTEWLRAPRCRQRRAFPLSSGCGRDRTRPRSPSRERPSWAAGARWVGPSWAHCSP

SEQ ID NO: 9237 - protein, 29 aa, Canis lupus familiaris
GPCAPLPLATAHHPAQQGRKQQGRRHLLL

SEQ ID NO: 9238 - protein, 16 aa, Canis lupus familiaris
GPCRRMQSMSSECRNQ

SEQ ID NO: 9239 - protein, 16 aa, Canis lupus familiaris
GPEGPASSRHAVPAAP

SEQ ID NO: 9240 - protein, 28 aa, Canis lupus familiaris
GPELKSLYGPILSICRTCHLSVCPRVPH

SEQ ID NO: 9241 - protein, 12 aa, Canis lupus familiaris
GPEWLGPQAPCL

SEQ ID NO: 9242 - protein, 8 aa, Canis lupus familiaris
GPFSSSPR

SEQ ID NO: 9243 - protein, 57 aa, Canis lupus familiaris
GPGEEEPAMCTSQRKARRSLWRPSKAMSSSATTCRITRSRAARTRSLWPSAPCSATG

SEQ ID NO: 9244 - skipped

SEQ ID NO: 9245 - protein, 61 aa, Canis lupus familiaris
GPGPAPRALRAPPARGPSHLALKVSPSAACPPRLWQLVPSSGVRPRAAPAAPSRTPPAARP

SEQ ID NO: 9246 - protein, 34 aa, Canis lupus familiaris
GPGPGAARGCAAASSRAPWTARPGRWRPSACAGA

SEQ ID NO: 9247-9248 - skipped (2 entries)

SEQ ID NO: 9249 - protein, 39 aa, Canis lupus familiaris
GPGTPRGFPEKWTSAPVRLRHGPSARGCSRWGRPAPGRG

SEQ ID NO: 9250 - skipped

SEQ ID NO: 9251 - protein, 11 aa, Canis lupus familiaris
GPLSTSSCPQG

SEQ ID NO: 9252 - protein, 43 aa, Canis lupus familiaris
GPPGALRHPRGAPSGPENHLGVYPEARLGLQQSEPHFSSLEPG

SEQ ID NO: 9253 - protein, 15 aa, Canis lupus familiaris
GPPGPEGILQRLFQL

SEQ ID NO: 9254 - protein, 36 aa, Canis lupus familiaris
GPPGRGSLEGARSPRGCTAPSWSACGLGLPSAASTT

SEQ ID NO: 9255 - protein, 17 aa, Canis lupus familiaris
GPPPLSRETPPSHSPPV

SEQ ID NO: 9256 - skipped

SEQ ID NO: 9257 - protein, 30 aa, Canis lupus familiaris
GPPQTLCPWRPLPEPISWTRDLPVCTWLPG

SEQ ID NO: 9258 - skipped

SEQ ID NO: 9259 - protein, 12 aa, Canis lupus familiaris
GPQTAAQQAGGL

SEQ ID NO: 9260 - protein, 42 aa, Canis lupus familiaris
GPRGGAPWRGLGHPEGAQRHRGAPAGSDCHLPPAPPELRRPL

SEQ ID NO: 9261 - protein, 15 aa, Canis lupus familiaris
GPRHAAPLRVWGLLF

SEQ ID NO: 9262 - protein, 44 aa, Canis lupus familiaris
GPSAGPPVGTTRTPTRTRRAEGTATGPATWSSTPRACPGQPFTA

SEQ ID NO: 9263 - protein, 46 aa, Canis lupus familiaris
GPSRGNLYRCPRSEDGARLAEQDSERGTSFWPSMGSPAPASPMPVP

SEQ ID NO: 9264 - protein, 19 aa, Canis lupus familiaris
GPSRRGYQACSSDSPWPHP

SEQ ID NO: 9265 - protein, 8 aa, Canis lupus familiaris
GPVNRQRN

SEQ ID NO: 9266 - protein, 36 aa, Canis lupus familiaris
GPVPEEPQLLKPPAQERGCPLCWGEAPVSALQPLAL

SEQ ID NO: 9267 - protein, 11 aa, Canis lupus familiaris
GPVTTQNSWRG

SEQ ID NO: 9268 - skipped

SEQ ID NO: 9269 - protein, 15 aa, Canis lupus familiaris
GPWRRSGPPGWWITS

SEQ ID NO: 9270 - protein, 57 aa, Canis lupus familiaris
GQASVARSPHSGNCPHVQGPSCSGVPGVWRPDPLASPRGRQVSRGPRRAAALSEAWS

SEQ ID NO: 9271 - protein, 44 aa, Canis lupus familiaris
GQGPGGRPAGALLATFDFLGRKGAGGGPAGKGRVPAHARSRGRG

SEQ ID NO: 9272 - protein, 10 aa, Canis lupus familiaris
GQHEGGRRCL

SEQ ID NO: 9273 - protein, 13 aa, Canis lupus familiaris
GQQSCPTPSSQGS

SEQ ID NO: 9274 - protein, 14 aa, Canis lupus familiaris
GQRLWSPQRIRGGT

SEQ ID NO: 9275 - protein, 56 aa, Canis lupus familiaris
GQRRNIQTKPRPGFPPWRCQHVCPLPLPRLRHHPDRLREVRGLCNCSVNFTERNRP

SEQ ID NO: 9276 - protein, 14 aa, Canis lupus familiaris
GQSKWPCSWHLCQP

SEQ ID NO: 9277 - protein, 65 aa, Canis lupus familiaris
GRAEETFTGVQDPKTEPGWQSRTPREGPAFGHQWGLLHQPLPCQCHEPHRCLRESAYPHSAAGRG

SEQ ID NO: 9278 - skipped

SEQ ID NO: 9279 - protein, 99 aa, Canis lupus familiaris
GREQTNKPLDVIGHGIRQSSQSPAHGLVRGRRGHLGRRCRRVSQGRGRAGPRPPRARPAGGRASGVRAPLRGGAPRPPTAVRRPPGVRSGPGSLRDRLM

SEQ ID NO: 9280 - protein, 26 aa, Canis lupus familiaris
GRERRSRRCAPANERQGGVCGDLQRQ

SEQ ID NO: 9281 - protein, 24 aa, Canis lupus familiaris
GRGAGGGFHLHEDVARNPTALWSP

SEQ ID NO: 9282 - protein, 45 aa, Canis lupus familiaris
GRGALGGPRDAGARRGGEPRGPESSTSPQPTGLCLLTKAVPSVLW

SEQ ID NO: 9283 - protein, 64 aa, Canis lupus familiaris
GRGGARACGLGLVLTPGPQETAAGTEGGGSTAQSPASGAEDEQVAACLRPSHQTKEVTSLWPKG

SEQ ID NO: 9284 - skipped

SEQ ID NO: 9285 - protein, 72 aa, Canis lupus familiaris
GRGRGQSPGPARPGARPPQPPPLRGGRLQGALQRQPQRRGLRGQGPPGAQLHPRTSALQEWLQGECARDADL

SEQ ID NO: 9286 - skipped

SEQ ID NO: 9287 - protein, 99 aa, Canis lupus familiaris
GRGRGRGGRGRRGRRRGRGRGRGRRPRRGQLLAVHWGPGGAAEVAGGQRRAPAGAQGDGDPGRHQHGGAEGLHHRHHPLRARRGDPGHAGQPAAQRARC

SEQ ID NO: 9288 - protein, 24 aa, Canis lupus familiaris
GRGRPSSPPPLPQPGPGPWHVRRA

SEQ ID NO: 9289 - skipped

SEQ ID NO: 9290 - protein, 66 aa, Canis lupus familiaris
GRHPPVLGHVVAGPPTDYDSRRAPRLRAGKPRIRIRAAASGWGVRSRGTWPRGQTRWWDSASSPLA

SEQ ID NO: 9291 - protein, 8 aa, Canis lupus familiaris
GRHPQEER

SEQ ID NO: 9292 - protein, 16 aa, Canis lupus familiaris
GRHRGASHGPVPGLCG

SEQ ID NO: 9293 - protein, 81 aa, Canis lupus familiaris
GRLARGRGVGARAVAGRCLPGAPGFSFPARPQLLRGRLLSPAVRRPLPQPAGLARQPGSLFRGRAGLLHQHPLCHRPAVPL

SEQ ID NO: 9294 - protein, 17 aa, Canis lupus familiaris
GRPPCPGRRPPATAHLL

SEQ ID NO: 9295 - protein, 54 aa, Canis lupus familiaris
GRPPCPPGRGLPLTPSVLPPRCPRAPTAPRPGSPADRVRQVRPVLRAPGPPSTS

SEQ ID NO: 9296 - protein, 15 aa, Canis lupus familiaris
GRPPRMSGSLPSRRF

SEQ ID NO: 9297 - skipped

SEQ ID NO: 9298 - protein, 43 aa, Canis lupus familiaris
GRPRQVGPVQGCGRGPGRSIRELPPEQELLLHRPHEGQGRVQV

SEQ ID NO: 9299 - protein, 27 aa, Canis lupus familiaris
GRRACGRSSATGCRAGGWDRTTSRCCM

SEQ ID NO: 9300 - skipped

SEQ ID NO: 9301 - protein, 9 aa, Canis lupus familiaris
GRRGRWHRM

SEQ ID NO: 9302-9304 - skipped (3 entries)

SEQ ID NO: 9305 - protein, 84 aa, Canis lupus familiaris
GRRRRWGQAGAPRAGLPSPRTLPGRAPCTTPGHPGRLPAAEGARLRRPLLWGAVQLRCCPGHPHRPRPHAAPAPRLASPPPYTG

SEQ ID NO: 9306 - protein, 17 aa, Canis lupus familiaris
GRRRSCHPSISVQKPLV

SEQ ID NO: 9307 - protein, 8 aa, Canis lupus familiaris
GRSGAPGS

SEQ ID NO: 9308 - protein, 20 aa, Canis lupus familiaris
GRSPRGGQSRRASQCTWEVR

SEQ ID NO: 9309 - protein, 44 aa, Canis lupus familiaris
GRVRGLQWGRRGLRRGQGGRRGRRLAQPRGVLRLGRVLVSLSRL

SEQ ID NO: 9310 - skipped

SEQ ID NO: 9311 - protein, 19 aa, Canis lupus familiaris
GRWGRRGPRRGQLRGRTCL

SEQ ID NO: 9312 - protein, 18 aa, Canis lupus familiaris
GSAASSKSRSLWWSSPCS

SEQ ID NO: 9313 - protein, 56 aa, Canis lupus familiaris
GSEQVAMQLAPLPALTAPVAPSTAWRPSPGPATTSPAPASSSSASCWSTSCSCPGW

SEQ ID NO: 9314 - protein, 23 aa, Canis lupus familiaris
GSFILPASSKTPVGGRTGPVAAA

SEQ ID NO: 9315 - protein, 34 aa, Canis lupus familiaris
GSGAGARTGSCPLHCRTSAELRGHKSLVRCLPSN

SEQ ID NO: 9316 - protein, 37 aa, Canis lupus familiaris
GSHTAPPRRRSCGSACHTRTGPRTPRPGPRARWARCS

SEQ ID NO: 9317 - protein, 11 aa, Canis lupus familiaris
GSLGEGTPADP

SEQ ID NO: 9318 - protein, 52 aa, Canis lupus familiaris
GSLPWGWGGTPQCYCIHTLWLWGHLGPGQPGPRLRQLHGAAAADAETADVQS

SEQ ID NO: 9319 - skipped

SEQ ID NO: 9320 - protein, 10 aa, Canis lupus familiaris
GSSATPPGGF

SEQ ID NO: 9321 - protein, 30 aa, Canis lupus familiaris
GSSAVAVGGPTPRIGPTPSRSSSPTGRAWS

SEQ ID NO: 9322 - protein, 22 aa, Canis lupus familiaris
GSSDCSTASWWALRPCRPQARP

SEQ ID NO: 9323 - protein, 21 aa, Canis lupus familiaris
GSSPPWTGICTASPRLWGTCP

SEQ ID NO: 9324 - protein, 82 aa, Canis lupus familiaris
GTALSRRCRSARSTCSARTRCSRRSWAPARRAWTRCCGTTPSWTPRRCACARRTGSTPATRARAPAAAPAPWCGWTSSTART

SEQ ID NO: 9325 - skipped

SEQ ID NO: 9326 - protein, 22 aa, Canis lupus familiaris
GTDRPVWGNRSSCRSTYWSPRC

SEQ ID NO: 9327 - protein, 26 aa, Canis lupus familiaris
GTLPERWAKQASIPVHLGSQVSPGPR

SEQ ID NO: 9328 - protein, 13 aa, Canis lupus familiaris
GTPPNPVPMEAPA

SEQ ID NO: 9329 - protein, 19 aa, Canis lupus familiaris
GTPRRQSLLVPRVPAATPL

SEQ ID NO: 9330 - protein, 38 aa, Canis lupus familiaris
GTRAPQLPSPPSTAGPGALARPARLIWPDAIKSELGPA

SEQ ID NO: 9331 - protein, 94 aa, Canis lupus familiaris
GTRVLLRPAPGRVRLCAQLLPHRQAALPGRRVRAALRGGAGLLGHRRDGRGALLLDDLPAAPRRRGGARHLRDARPPGWRPRRRRRPGGQEAGH

SEQ ID NO: 9332 - protein, 35 aa, Canis lupus familiaris
GTSETSGTSTRVWAWPWTIHTRTTAGTRATPSSPA

SEQ ID NO: 9333 - protein, 8 aa, Canis lupus familiaris
GVAASLLA

SEQ ID NO: 9334 - protein, 16 aa, Canis lupus familiaris
GVAEACRGRSSPRRCC

SEQ ID NO: 9335 - protein, 58 aa, Canis lupus familiaris
GVARVEVAAGPPMREVAEAAAVVMVVRPVATLSPVEPRTPLESVRQIYSEHNYCRLVL

SEQ ID NO: 9336 - protein, 12 aa, Canis lupus familiaris
GVAVPWSTSPRL

SEQ ID NO: 9337 - protein, 53 aa, Canis lupus familiaris
GVGALLMAPLSPGATQTSTSCSTMFCLSRPDFLTGPPPGWAASQRLTWVCHHR

SEQ ID NO: 9338 - protein, 45 aa, Canis lupus familiaris
GVGALLMAPLSPGATQTSTSCSTMFCLSRPGWAASQRLTWVCHHR

SEQ ID NO: 9339 - protein, 42 aa, Canis lupus familiaris
GVGSWSAHRILSLALPNLSGTAWPQVPGAVSAIQLEDRLRLP

SEQ ID NO: 9340 - protein, 24 aa, Canis lupus familiaris
GVLSAPSVSCCSCCSQFCVSCEFS

SEQ ID NO: 9341 - protein, 19 aa, Canis lupus familiaris
GVLYSQQVRRPQWGEEQDP

SEQ ID NO: 9342 - protein, 41 aa, Canis lupus familiaris
GVPGRSALGPPRKGRREARGGCWGGASLRVCGRAFSGEPVA

SEQ ID NO: 9343 - skipped

SEQ ID NO: 9344 - protein, 34 aa, Canis lupus familiaris
GVPSSQFPALSLFPPSRAVLRMAPGYDITEPPPL

SEQ ID NO: 9345 - skipped

SEQ ID NO: 9346 - protein, 24 aa, Canis lupus familiaris
GWGLKCLGIGEDWSKNSVSWNKGN

SEQ ID NO: 9347 - protein, 37 aa, Canis lupus familiaris
GWGPYLWPPSALGPPRRPHHAAPCSAYPGQAGQHRRD

SEQ ID NO: 9348 - protein, 32 aa, Canis lupus familiaris
GWGPYLWPPSALGPPRRPHHAAPCSAYPGQTS

SEQ ID NO: 9349 - protein, 10 aa, Canis lupus familiaris
GWILSRKPQL

SEQ ID NO: 9350 - protein, 51 aa, Canis lupus familiaris
GWKGAGVEVAEQAERGKPREAQSLCPSREEDLGFLSKVLQPQEGDLCYANL

SEQ ID NO: 9351 - protein, 12 aa, Canis lupus familiaris
GWPGWRWRRGHR

SEQ ID NO: 9352 - skipped

SEQ ID NO: 9353 - protein, 84 aa, Canis lupus familiaris
GWQPASWPELRAAATTTPSSTATSAPILTHQSWRWSACQEGQGWAQCFGLLSHHQQADLPLDERVPTELQAKEQLCHCRRELRG

SEQ ID NO: 9354 - protein, 21 aa, Canis lupus familiaris
GWRRPAGGALPRDGAAEPGRR

SEQ ID NO: 9355 - protein, 19 aa, Canis lupus familiaris
GWWRLEEDWTSPTCLFSGS

SEQ ID NO: 9356 - protein, 17 aa, Canis lupus familiaris
VGHPECQEASHLEGSRK

SEQ ID NO: 9357 - protein, 8 aa, Canis lupus familiaris
VPAGECRV

SEQ ID NO: 9358 - protein, 30 aa, Canis lupus familiaris
VQNQILLSGGNRRITFVCFCLYLAPEQRLC

SEQ ID NO: 9359 - protein, 32 aa, Canis lupus familiaris
VTAHCTPHCPLQVTAHLCPLQGHCPLPTLLPP

SEQ ID NO: 9360 - protein, 94 aa, Canis lupus familiaris
AGSGGKYHPGGVKKTPWGERGGRDDGGGQHRRRHRAAAAAPGAQKTQAPERRWREQRWRTSEAESGAWGRARGRAARDRSRDTQRRARAGARPG

SEQ ID NO: 9361 - protein, 71 aa, Canis lupus familiaris
AKPHFPEGWWLPREWDPRAGVRDPEITAAGGEHRQGHHRPQRMSHLPPGLELPKLPQDALPHPHRGEAVPV

SEQ ID NO: 9362 - skipped

SEQ ID NO: 9363 - protein, 51 aa, Canis lupus familiaris
GAAASVRVCARVCSCVCKRVWVCPCVQESVHATRTSSIPGKATGSSGPRER

SEQ ID NO: 9364 - skipped

SEQ ID NO: 9365 - protein, 48 aa, Canis lupus familiaris
GAAPPWPSLSLPAGPPAPSARWWFSYQTMTAASQKCLRNTCTMRSHSS

SEQ ID NO: 9366 - protein, 30 aa, Canis lupus familiaris
GAARARRAGTARGSGCCLRWRTWRSCRENL

SEQ ID NO: 9367 - protein, 76 aa, Canis lupus familiaris
GAGGVGCVSLAGLLSSQQLSSSPSEPRGCLWSFPGPFLYVPPRPRLLGVWWERQLYPGLLRLLNRHWRDSWGLGGT

SEQ ID NO: 9368 - skipped

SEQ ID NO: 9369 - protein, 56 aa, Canis lupus familiaris
GALGTHCRVARPSPGCPYRAPGRRGSGPRPGRQCSPEKPTWGPGRPPHLCALYWSP

SEQ ID NO: 9370 - skipped

SEQ ID NO: 9371 - protein, 25 aa, Canis lupus familiaris
GAPRSGPGRPSGPVPSPRGPRWPRR

SEQ ID NO: 9372 - protein, 17 aa, Canis lupus familiaris
GARCPSASGLGRPVCHL

SEQ ID NO: 9373 - protein, 21 aa, Canis lupus familiaris
GARTPAVSPRRCRSPAAGGRT

SEQ ID NO: 9374 - protein, 14 aa, Canis lupus familiaris
GASRPSWRPWVTRR

SEQ ID NO: 9375 - protein, 43 aa, Canis lupus familiaris
GASRSSPSTGTRTTTTKPSLVATARTKMLAASMTILRLLIAMI

SEQ ID NO: 9376 - protein, 12 aa, Canis lupus familiaris
GASSSSCPPNCN

SEQ ID NO: 9377 - protein, 52 aa, Canis lupus familiaris
GAVRRPGRCPEPCIGSHRTAGISRPARIRAGGCGLPRTPPDSPGLPGQVQAE

SEQ ID NO: 9378 - protein, 20 aa, Canis lupus familiaris
GAWRAPGPWWRGWVAPASRH

SEQ ID NO: 9379 - protein, 65 aa, Canis lupus familiaris
GEVKGPQESKEDRHRLPTYSLPGPARPQGRPLPPAEWNPSTPGASPVTTVRIRVEMTAGVLTCFV

SEQ ID NO: 9380 - protein, 36 aa, Canis lupus familiaris
GFSPGGVQNQILLSGGNRRITFVCFCLYLAPEQRLC

SEQ ID NO: 9381 - protein, 44 aa, Canis lupus familiaris
GGAVGSRRPAQSGAVVRSGGLRRGPRGASGGGGQTARGPPTGGV

SEQ ID NO: 9382 - protein, 22 aa, Canis lupus familiaris
GGDEVQGPNPEALDHSGFMAAL

SEQ ID NO: 9383 - protein, 22 aa, Canis lupus familiaris
GGPRGQEGRLGLPLNPHPIQNV

SEQ ID NO: 9384 - protein, 36 aa, Canis lupus familiaris
GHCRGGRAPGDCAVASATAARGRELGRAGAAVRPTR

SEQ ID NO: 9385 - protein, 31 aa, Canis lupus familiaris
GHGALRHQASEGQFATCDSFRPQVPHRESRS

SEQ ID NO: 9386 - protein, 65 aa, Canis lupus familiaris
GKAGNTGPGTGGSSGNSWATGAGFSPSWKGPNPSWTTRTGPGSGRTTAGPATGCPAPTSGKRALE

SEQ ID NO: 9387 - protein, 49 aa, Canis lupus familiaris
GLGRPPCLPADAGAQLLGAALESGSDAEASRRRLCARLCGGRGRLRGEA

SEQ ID NO: 9388 - protein, 28 aa, Canis lupus familiaris
GLHRLGPRCLCLQGRLLRQQGGGFLTKR

SEQ ID NO: 9389 - protein, 32 aa, Canis lupus familiaris
GLPHHPAPPTATRARHLHSLYPPEASTMPWAL

SEQ ID NO: 9390 - protein, 73 aa, Canis lupus familiaris
GLQEPVGAPSSARRSRPGGRRTQEARVQLLPPGPAPPLVAEPGAARSAAAAWILQSADEDGAATSGGDGGAGP

SEQ ID NO: 9391 - skipped

SEQ ID NO: 9392 - protein, 61 aa, Canis lupus familiaris
GLRGGTLGAAIGPRRDGAPCAPPGASAARPRSSTHAAMRARRGGRAGARGCRQPPGAAVHC

SEQ ID NO: 9393 - protein, 37 aa, Canis lupus familiaris
GPAAGAPQPPFPVQRSPRSPRDTRPCSRARTRPPTRP

SEQ ID NO: 9394 - protein, 40 aa, Canis lupus familiaris
GPAGAGGGALERTEVEAWRTQDAGSSGPAAASGPRPAARR

SEQ ID NO: 9395 - protein, 48 aa, Canis lupus familiaris
GPALREKKLGPPPAQLHLPAPAPRPQRPPTRACPSLNIAAWIPASRCC

SEQ ID NO: 9396 - protein, 56 aa, Canis lupus familiaris
GPGGPISSGPPCSPTPRPPSPALPALWPLTPWGGPTRHPTLPALLPCYSPPGSSSP

SEQ ID NO: 9397 - protein, 32 aa, Canis lupus familiaris
GPQDQVPQLVRGQQLQSPLWWQRHGRRCWQLL

SEQ ID NO: 9398 - protein, 80 aa, Canis lupus familiaris
GPWGRIAGWRGRPQDAHTAPPGDEAPAHVPGDSAARRSRRGAQGALHTFALCIGVRRPQRKVGERRPRAWRRPASRVPTT

SEQ ID NO: 9399 - protein, 10 aa, Canis lupus familiaris
GQAVLPGDPG

SEQ ID NO: 9400 - skipped

SEQ ID NO: 9401 - protein, 18 aa, Canis lupus familiaris
GQLFSVVLGPLTSLSPST

SEQ ID NO: 9402 - skipped

SEQ ID NO: 9403 - protein, 24 aa, Canis lupus familiaris
GQTTLPRGLVASKGVGPPSRGQRP

SEQ ID NO: 9404 - protein, 22 aa, Canis lupus familiaris
GRAPRAGGTTGAPPQPSSYSKC

SEQ ID NO: 9405 - protein, 63 aa, Canis lupus familiaris
GRPGAGRGGRAALSPAPGAQGGRGGEEEKEGGPGPGRRRPGGRRGRRRGGARGGRGARGAGVR

SEQ ID NO: 9406 - protein, 42 aa, Canis lupus familiaris
GRRALAPQLADVQCRGGGLRLRRGRRRRDHQQNRHRHRGLHG

SEQ ID NO: 9407 - skipped

SEQ ID NO: 9408 - protein, 44 aa, Canis lupus familiaris
GRRSGVEASCPERGGGQERGAAPGAAGGFRRRRPDSPRTSDGGC

SEQ ID NO: 9409 - protein, 55 aa, Canis lupus familiaris
GRSKVRKRAKKTGTGCQPTASRVPPGLRVGPCLLPSGIHPPRGPLLSRLCESVWR

SEQ ID NO: 9410 - protein, 24 aa, Canis lupus familiaris
GRWAAGGSPGAQGQRRSRPRRGRR

SEQ ID NO: 9411 - protein, 82 aa, Canis lupus familiaris
GSGSRGAKDTFSNARVTPEPSRMKREAGGLAEPWAEDCCFPRVGSLTGPLPFGGFRCHRCSQRRGPRSAGSVRAFGTHPGAS

SEQ ID NO: 9412 - protein, 37 aa, Canis lupus familiaris
GSRNHGDGGRLGGATGSRTSAQGRTDRTGQGADHGGR

SEQ ID NO: 9413 - protein, 8 aa, Canis lupus familiaris
GSWRYFIK

SEQ ID NO: 9414 - protein, 22 aa, Canis lupus familiaris
GVEAAAQRTHFQTLVLPPSPRE

SEQ ID NO: 9415 - protein, 78 aa, Canis lupus familiaris
GVFARAVSRSRSAGRRRPQPSQRWNDGCTRAGRLARRCGRSWAPAHLWTEPRTRRSCWGRCRPWWGAPCSTTRRPGCR

SEQ ID NO: 9416 - skipped

SEQ ID NO: 9417 - protein, 20 aa, Canis lupus familiaris
GWGGGGADGPRPLCSSPWPP

SEQ ID NO: 9418 - protein, 22 aa, Canis lupus familiaris
FALCGFWQICRIKKHFQTHRLL

SEQ ID NO: 9419 - protein, 12 aa, Canis lupus familiaris
FCFFVFFFFFCP

SEQ ID NO: 9420 - protein, 20 aa, Canis lupus familiaris
FFPFWQQQLQQRKHQGSFLL

SEQ ID NO: 9421 - protein, 17 aa, Canis lupus familiaris
FHCIWMPGQFTPDRNGL

SEQ ID NO: 9422 - protein, 10 aa, Canis lupus familiaris
FHDVCGRENI

SEQ ID NO: 9423 - protein, 13 aa, Canis lupus familiaris
FKRQLPWKNSLYL

SEQ ID NO: 9424 - protein, 15 aa, Canis lupus familiaris
FPKVRLGTPSNYSTS

SEQ ID NO: 9425 - skipped

SEQ ID NO: 9426 - protein, 13 aa, Canis lupus familiaris
FQKAIALEKFTLL

SEQ ID NO: 9427 - protein, 12 aa, Canis lupus familiaris
FSLYLDAWTIYS

SEQ ID NO: 9428 - protein, 18 aa, Canis lupus familiaris
FVFLFFFFFFVLKILHVP

SEQ ID NO: 9429-9430 - skipped (2 entries)

SEQ ID NO: 9431 - protein, 28 aa, Canis lupus familiaris
LEMQPSGKRYPCALGLHLGGRGLRAAGG

SEQ ID NO: 9432 - protein, 23 aa, Canis lupus familiaris
LLCVVSGKFVVSRSTFRHTGCYS

SEQ ID NO: 9433 - protein, 22 aa, Canis lupus familiaris
SFLFGNSSCSSGNIRALFSFRI

SEQ ID NO: 9434 - protein, 39 aa, Canis lupus familiaris
WKCSHPGSAIPVPWDCTWGAGGSVLQDSRCKHAVKKSTK

SEQ ID NO: 9435 - protein, 69 aa, Canis lupus familiaris
WKCSHPGSAIPVPWDCTWGAGGSVLQIILLQNSLTVFWEIMDRHIPMHALPEEIQKDSRCKHAVKKSTK

SEQ ID NO: 9436 - protein, 30 aa, Canis lupus familiaris
WKCSHPGSAIPVPWDCTWGAGGSVLQVGRP

SEQ ID NO: 9437 - protein, 9 aa, Canis lupus familiaris
FHRSHPGAG

SEQ ID NO: 9438 - protein, 22 aa, Canis lupus familiaris
FIIIEFILVRNPMDVKFVLRHF

SEQ ID NO: 9439 - protein, 17 aa, Canis lupus familiaris
FLSLSLSLSLFLFLFLY

SEQ ID NO: 9440 - protein, 13 aa, Canis lupus familiaris
FSISLFLRKKCLL

SEQ ID NO: 9441 - protein, 48 aa, Canis lupus familiaris
FSLSLSLSLSFFFFFFIKRLQKKPPTLRDDRRGQFYESHPGLWKILLL

SEQ ID NO: 9442 - protein, 78 aa, Canis lupus familiaris
FSPVASRGWVDTLKTPPSTTTGCPSWSPSWGPMSSPAASSVFLACVWTHSSSVSWKTWRGTTARRTGPTTCPKPFSRS

SEQ ID NO: 9443 - protein, 11 aa, Canis lupus familiaris
FAFLSFLSATC

SEQ ID NO: 9444 - protein, 10 aa, Canis lupus familiaris
FFFLFFFFFF

SEQ ID NO: 9445 - protein, 20 aa, Canis lupus familiaris
FKRKFLTWVKTCFFKESFHQ

SEQ ID NO: 9446 - protein, 21 aa, Canis lupus familiaris
LTGHNLGGKKTSPLLNPHMLK

SEQ ID NO: 9447 - protein, 10 aa, Canis lupus familiaris
SFFFFFFFFL

SEQ ID NO: 9448 - protein, 19 aa, Canis lupus familiaris
LHRKPGGYTECQRQINRGP

SEQ ID NO: 9449 - protein, 14 aa, Canis lupus familiaris
LARMEWLQSLWTLG

SEQ ID NO: 9450 - skipped

SEQ ID NO: 9451 - protein, 13 aa, Canis lupus familiaris
FFPCPPFPTLLQP

SEQ ID NO: 9452 - protein, 31 aa, Canis lupus familiaris
SFLVPRFRLFFNRSLVFNLCSLSGRILPFPG

SEQ ID NO: 9453 - protein, 16 aa, Canis lupus familiaris
FLLYSKVSRDKVLDET

SEQ ID NO: 9454 - protein, 10 aa, Canis lupus familiaris
FPSLQQSIQR

SEQ ID NO: 9455 - protein, 9 aa, Canis lupus familiaris
FVLKILHVP

SEQ ID NO: 9456 - skipped

SEQ ID NO: 9457 - protein, 20 aa, Canis lupus familiaris
FSLGVLGFCFFFLSLGASVV

SEQ ID NO: 9458 - protein, 13 aa, Canis lupus familiaris
FTALKDSHVKLNT

SEQ ID NO: 9459 - protein, 8 aa, Canis lupus familiaris
LLPSKTVM

SEQ ID NO: 9460 - protein, 39 aa, Canis lupus familiaris
FVYWECCLLCLCLCLPAILLLGWVVLFFSLSSSSQINLA

SEQ ID NO: 9461 - protein, 20 aa, Canis lupus familiaris
LFIGNVVSCASVFVCLPFFC

SEQ ID NO: 9462 - protein, 21 aa, Canis lupus familiaris
LLLQVSEYCAFMGLFFMKQSV

SEQ ID NO: 9463 - protein, 22 aa, Canis lupus familiaris
CAPAGPDAGTKSSSGSYLHPAV

SEQ ID NO: 9464 - protein, 26 aa, Canis lupus familiaris
CASCRCASRTLLGNNGGTGICAADCF

SEQ ID NO: 9465 - protein, 20 aa, Canis lupus familiaris
CCCKNCKRTWSFQYSFLLHR

SEQ ID NO: 9466 - protein, 29 aa, Canis lupus familiaris
CCGHSLCGQEAGAPGLPLHTPELGSAVQS

SEQ ID NO: 9467 - protein, 11 aa, Canis lupus familiaris
CCSEQTFSFIY

SEQ ID NO: 9468 - protein, 22 aa, Canis lupus familiaris
CCVCDYFVCFHITHHVASSCLY

SEQ ID NO: 9469 - protein, 9 aa, Canis lupus familiaris
CEQDFASVS

SEQ ID NO: 9470 - protein, 49 aa, Canis lupus familiaris
CERIRCKQCESSFTRQHHPIQSLGGRSERSYPTANLQQHPQPPDLLLLL

SEQ ID NO: 9471 - protein, 34 aa, Canis lupus familiaris
CGEHWLVGPVYGRRSPGDCLPCRWHHETWGAHLQ

SEQ ID NO: 9472 - protein, 42 aa, Canis lupus familiaris
CGFYCCKWSVSSASTFNLQLHWVLCLCGLPWICIWMAQLSVV

SEQ ID NO: 9473 - skipped

SEQ ID NO: 9474 - protein, 8 aa, Canis lupus familiaris
CGVHLCGS

SEQ ID NO: 9475 - protein, 16 aa, Canis lupus familiaris
CHLSCLQNAPHHSNQL

SEQ ID NO: 9476 - protein, 8 aa, Canis lupus familiaris
CHNECKNE

SEQ ID NO: 9477 - protein, 50 aa, Canis lupus familiaris
CHQYQNRFDHNNFKEIGSRTAGRTFSRGDCDGWRLLSQTIHHLGGGSGFG

SEQ ID NO: 9478 - protein, 16 aa, Canis lupus familiaris
CKNTPALATHYSNRRP

SEQ ID NO: 9479 - protein, 21 aa, Canis lupus familiaris
CKQGIRIFASSVAASYHWQTE

SEQ ID NO: 9480 - protein, 51 aa, Canis lupus familiaris
CLGTCEDLFLISFCHFQHVARIPHFHVLLRNEGECAGAVADTLLLRVVTTG

SEQ ID NO: 9481 - protein, 14 aa, Canis lupus familiaris
CLQRKPTSSLCQGT

SEQ ID NO: 9482 - protein, 22 aa, Canis lupus familiaris
CNVPFWESDLLFNMEKEDNLDS

SEQ ID NO: 9483 - protein, 13 aa, Canis lupus familiaris
CQRQPRGAAQPGC

SEQ ID NO: 9484 - protein, 8 aa, Canis lupus familiaris
CQVDPKCH

SEQ ID NO: 9485 - protein, 33 aa, Canis lupus familiaris
CRRICPPAKLPAGSSPVPSGGLGAFSCSWTGPK

SEQ ID NO: 9486 - protein, 9 aa, Canis lupus familiaris
CSFASESSC

SEQ ID NO: 9487 - protein, 42 aa, Canis lupus familiaris
CSFYCCKWSVSSASTFILQLHWVLCLCGLLWICVWMAQLSVV

SEQ ID NO: 9488 - protein, 9 aa, Canis lupus familiaris
CSHLLPHTV

SEQ ID NO: 9489 - protein, 27 aa, Canis lupus familiaris
CSLPRNQGGCTQKPFPGQGTSFVMHRG

SEQ ID NO: 9490 - protein, 9 aa, Canis lupus familiaris
CSPVPCAQH

SEQ ID NO: 9491 - protein, 18 aa, Canis lupus familiaris
CSQEVHPKSQLSHQPCQQ

SEQ ID NO: 9492 - protein, 13 aa, Canis lupus familiaris
CSSGTAAKSSFEE

SEQ ID NO: 9493 - protein, 16 aa, Canis lupus familiaris
CTLFYIRFKISVLWKN

SEQ ID NO: 9494 - protein, 41 aa, Canis lupus familiaris
CTTTSIHPREGSASFTTAEAGWSSARSTYSSGHTGSGAQAS

SEQ ID NO: 9495 - protein, 12 aa, Canis lupus familiaris
CTYICRIWILSL

SEQ ID NO: 9496 - protein, 19 aa, Canis lupus familiaris
CVLTTAHSGMYGILCRSYF

SEQ ID NO: 9497 - protein, 44 aa, Canis lupus familiaris
CVWTGLVILLSRENQPALRPAVLQALRWGRLHLADPQEPEERLC

SEQ ID NO: 9498 - protein, 57 aa, Canis lupus familiaris
CWALGPLHSCKQSIQPAQFQHHWELQCNSEDDAGPCGGQQCPGEYSVPSPSSLHPCL

SEQ ID NO: 9499 - protein, 44 aa, Canis lupus familiaris
CWCLLLSIFGRCDLWGFKQNIPQGVRYCANKPIKRFRKRTIGNS

SEQ ID NO: 9500 - protein, 19 aa, Canis lupus familiaris
CWRRRGDGREAHHTDLQPP

SEQ ID NO: 9501 - protein, 45 aa, Canis lupus familiaris
CWTMATQYGFSLRTAGYNQETQRFLYSHRPEDKAFETSGWGNICR

SEQ ID NO: 9502 - protein, 17 aa, Canis lupus familiaris
CYISWGNRILPLGFYVL

SEQ ID NO: 9503 - protein, 17 aa, Canis lupus familiaris
CYISWGNRVLSLGFYVL

SEQ ID NO: 9504 - skipped

SEQ ID NO: 9505 - protein, 13 aa, Canis lupus familiaris
FAEIRMCTQWPPC

SEQ ID NO: 9506 - protein, 13 aa, Canis lupus familiaris
FAEKQRFLILVGD

SEQ ID NO: 9507 - protein, 42 aa, Canis lupus familiaris
FAFFWQCGPHVPTLLCHLLLILGYSHCSGLCSFVSLLQPHHL

SEQ ID NO: 9508 - protein, 13 aa, Canis lupus familiaris
FAFHPYLLHHSGR

SEQ ID NO: 9509 - protein, 22 aa, Canis lupus familiaris
FAFLAFLSFMDLSLTIKLELYV

SEQ ID NO: 9510 - protein, 12 aa, Canis lupus familiaris
FAFYLASVLKKA

SEQ ID NO: 9511 - skipped

SEQ ID NO: 9512 - protein, 11 aa, Canis lupus familiaris
FAIVQNCFVLM

SEQ ID NO: 9513 - protein, 14 aa, Canis lupus familiaris
FALFMVLPSSQGLP

SEQ ID NO: 9514 - protein, 21 aa, Canis lupus familiaris
FALLLKNTVPRIISPIKHCSS

SEQ ID NO: 9515 - protein, 38 aa, Canis lupus familiaris
FALLLVCILWAVDGRKKKNKWNGMVVLNKSLNHVHLLE

SEQ ID NO: 9516 - protein, 11 aa, Canis lupus familiaris
FALRIMDRFDS

SEQ ID NO: 9517 - protein, 25 aa, Canis lupus familiaris
FAMPLWSGTPPFPHVSWATVLSLCW

SEQ ID NO: 9518 - protein, 17 aa, Canis lupus familiaris
FAPLLLQPNLGNLSSLC

SEQ ID NO: 9519 - protein, 96 aa, Canis lupus familiaris
FAPMPAASQTRGTLASWPGTRGSPGPRTTVLRLPAASATGGRAEKAMGMPEGTRGRQWARAAFWVGDSGQPCLLEGSPGGPPPPRPAAGAYRISCC

SEQ ID NO: 9520 - protein, 21 aa, Canis lupus familiaris
FAPTRSPTTSSCRRWRCCVSW

SEQ ID NO: 9521 - protein, 13 aa, Canis lupus familiaris
FARVACGTLQWAL

SEQ ID NO: 9522 - protein, 36 aa, Canis lupus familiaris
FARVSGKAKWSSESYMDLCVGTILVAGCLLLSLSQT

SEQ ID NO: 9523 - protein, 44 aa, Canis lupus familiaris
FASQEIFIVKTIGVCLKAGCVILRMTAVMAAMRRIAQLLCLPES

SEQ ID NO: 9524 - protein, 23 aa, Canis lupus familiaris
FATSCCTLWMSFHMETGQTFPHL

SEQ ID NO: 9525 - protein, 40 aa, Canis lupus familiaris
FAVASSVECDAVSEAVKDRICCSVLLPSPSPRREIFTFSL

SEQ ID NO: 9526 - protein, 52 aa, Canis lupus familiaris
FAVKRNGTRSLKPAGLLMPSTSLRQIYIQLNHSKEIQKSVSMPECLRLSQTC

SEQ ID NO: 9527 - protein, 12 aa, Canis lupus familiaris
FAVLWILPTVYL

SEQ ID NO: 9528 - protein, 20 aa, Canis lupus familiaris
FAVSPYHKSTVGRQWHTECL

SEQ ID NO: 9529 - protein, 21 aa, Canis lupus familiaris
FCAGTLLQMLLHLLSGTFWIF

SEQ ID NO: 9530 - protein, 44 aa, Canis lupus familiaris
FCFFLAMWPSCTYASLPPTPYSGIQSLLWPLQFCLPSSTPSFIA

SEQ ID NO: 9531 - protein, 8 aa, Canis lupus familiaris
FCFLFFFF

SEQ ID NO: 9532 - protein, 8 aa, Canis lupus familiaris
FCFLLYFT

SEQ ID NO: 9533 - protein, 26 aa, Canis lupus familiaris
FCFSHRDRELHRGSTETYRTARVQSQ

SEQ ID NO: 9534 - protein, 34 aa, Canis lupus familiaris
FCFSPHACFCTSGLLPHLQLIKICSLWILLSSLP

SEQ ID NO: 9535 - protein, 17 aa, Canis lupus familiaris
FCFSPLFTSPLWQVTGA

SEQ ID NO: 9536 - protein, 29 aa, Canis lupus familiaris
FCFWSIKLWKPTKEIRSVVFFLMTLVNPS

SEQ ID NO: 9537 - protein, 10 aa, Canis lupus familiaris
FCGCLLVWDY

SEQ ID NO: 9538 - protein, 33 aa, Canis lupus familiaris
FCHVRKNKCQNHQRRTEENRNMGIRIMKMLSSS

SEQ ID NO: 9539 - protein, 20 aa, Canis lupus familiaris
FCIWLWAYVSSAKVAFCSVV

SEQ ID NO: 9540 - protein, 32 aa, Canis lupus familiaris
FCLFLKEFLLLVHPEGLTFITILILLFIFKIL

SEQ ID NO: 9541 - protein, 40 aa, Canis lupus familiaris
FCLGHLAAMNWQLLVTQIQAHIPPFIRILAMSLMTQTGFI

SEQ ID NO: 9542 - protein, 42 aa, Canis lupus familiaris
FCLRLLMQTDWCMTQSWGAKPTTACSRWRDLGGSILCTQHRT

SEQ ID NO: 9543 - protein, 54 aa, Canis lupus familiaris
FCLVYGVTFQPRVALSCARGVMTGLTGLDAAVKTQTQFAAKFPLSHPGTLKNQH

SEQ ID NO: 9544 - protein, 19 aa, Canis lupus familiaris
FCMKLEEILENAALMTTRT

SEQ ID NO: 9545 - protein, 11 aa, Canis lupus familiaris
FCMSLAVLDPF

SEQ ID NO: 9546 - protein, 21 aa, Canis lupus familiaris
FCPAFLASSHPCHLPGQRWPV

SEQ ID NO: 9547 - skipped

SEQ ID NO: 9548 - protein, 37 aa, Canis lupus familiaris
FCQQETQIPSSHQMQPPSLQRLTSLQQEVGCEDSFWL

SEQ ID NO: 9549 - protein, 29 aa, Canis lupus familiaris
FCRCTPRKPAPEWHCLPAPWLWNMSMTLT

SEQ ID NO: 9550 - protein, 64 aa, Canis lupus familiaris
FCSAFLQGDPRWPGTAPSARRRGQRISCAPTATAGCAAHAQRSTGMAPPLGAHSFRGPTRDHQE

SEQ ID NO: 9551 - protein, 14 aa, Canis lupus familiaris
FCSSVQFWPDTCPF

SEQ ID NO: 9552 - skipped

SEQ ID NO: 9553 - protein, 19 aa, Canis lupus familiaris
FCTPFCTLSAKHDPLNIFD

SEQ ID NO: 9554 - protein, 42 aa, Canis lupus familiaris
FCVPGNYFLPGAHCWGSGICFQRLDQRPAVFLYKQQHQSVQR

SEQ ID NO: 9555 - protein, 11 aa, Canis lupus familiaris
FCWLLSWSLRP

SEQ ID NO: 9556 - skipped

SEQ ID NO: 9557 - protein, 18 aa, Canis lupus familiaris
FDLHLPQRSHHPGRDGGG

SEQ ID NO: 9558 - protein, 49 aa, Canis lupus familiaris
FDNTRLSYLCLSLCPVSCTCVKVAVSDDVGSYRLYCVCADFKYIDGNND

SEQ ID NO: 9559 - protein, 15 aa, Canis lupus familiaris
FDPGSETAKEANSIS

SEQ ID NO: 9560 - protein, 33 aa, Canis lupus familiaris
FDVALPKMQYIIARMVATVKWTCTCVGNVKSAD

SEQ ID NO: 9561 - protein, 16 aa, Canis lupus familiaris
FEAQVQPHFEARRLSV

SEQ ID NO: 9562 - protein, 9 aa, Canis lupus familiaris
FEDSILLLY

SEQ ID NO: 9563 - protein, 14 aa, Canis lupus familiaris
FEDWWCQSRPTKNP

SEQ ID NO: 9564 - protein, 16 aa, Canis lupus familiaris
FEEKMGSWILLKFVQK

SEQ ID NO: 9565 - protein, 21 aa, Canis lupus familiaris
FEGPRWWWENDFLHCESDRCG

SEQ ID NO: 9566 - protein, 33 aa, Canis lupus familiaris
FEIRTLAKITSSTRIRITCGHARICASIKEACS

SEQ ID NO: 9567 - protein, 11 aa, Canis lupus familiaris
FELPSRGFSSA

SEQ ID NO: 9568 - protein, 8 aa, Canis lupus familiaris
FEMFVRLS

SEQ ID NO: 9569 - protein, 10 aa, Canis lupus familiaris
FESSLLYYQR

SEQ ID NO: 9570 - protein, 11 aa, Canis lupus familiaris
FESTRLLTFKE

SEQ ID NO: 9571 - protein, 12 aa, Canis lupus familiaris
FETSPFTTSECL

SEQ ID NO: 9572 - protein, 29 aa, Canis lupus familiaris
FEWSFLTLPQDEQMLTISSMKLKGLERIY

SEQ ID NO: 9573 - protein, 20 aa, Canis lupus familiaris
FFACWITIPGYWSTYSNTSL

SEQ ID NO: 9574 - protein, 47 aa, Canis lupus familiaris
FFALLCAGSWSPGRPAAIPGELRAVGANYDPGHQGWLHWWRGCGLPQ

SEQ ID NO: 9575 - protein, 18 aa, Canis lupus familiaris
FFCLFYFLWILWLITQQV

SEQ ID NO: 9576 - protein, 20 aa, Canis lupus familiaris
FFHDTPFWSKHPPLYPYPFS

SEQ ID NO: 9577 - protein, 11 aa, Canis lupus familiaris
FFPKVHPLYLC

SEQ ID NO: 9578 - protein, 42 aa, Canis lupus familiaris
FFSEETMNVPASIEFMDFTMNVKEDITLNYGKLSQTALTVYR

SEQ ID NO: 9579 - protein, 42 aa, Canis lupus familiaris
FFSEETMNVSASIEFMDFTMNVKEDITLNYGKLSQTALTVYR

SEQ ID NO: 9580 - protein, 17 aa, Canis lupus familiaris
FFTTSWRRAHWKSRTSG

SEQ ID NO: 9581 - protein, 11 aa, Canis lupus familiaris
FGAEENAKKWP

SEQ ID NO: 9582 - protein, 38 aa, Canis lupus familiaris
FGALGLEHFKWKGIGRQMEKDPLYGIISSTHTLKMSTA

SEQ ID NO: 9583 - protein, 26 aa, Canis lupus familiaris
FGCQHLPLRKCQFSSSQWLQSECQEF

SEQ ID NO: 9584 - protein, 89 aa, Canis lupus familiaris
FGDIPVGLDRQPPHYHCNQLGPSPTVPHVLLLEAPLSSGPLLHLCHSPPVHHKFTYEQWLHFLCPVHSSGVLLHSSGLIRSGHPHSDVL

SEQ ID NO: 9585 - protein, 17 aa, Canis lupus familiaris
FGDRIGIWDLAQIFFAT

SEQ ID NO: 9586 - protein, 36 aa, Canis lupus familiaris
FGDWVLAMWAGEFCDTHSAGSHTHSLWAQPNQPLSL

SEQ ID NO: 9587 - protein, 11 aa, Canis lupus familiaris
FGEGSSMAGSN

SEQ ID NO: 9588 - skipped

SEQ ID NO: 9589 - protein, 16 aa, Canis lupus familiaris
FGGCHSQCGHDSTHPC

SEQ ID NO: 9590 - skipped

SEQ ID NO: 9591 - protein, 16 aa, Canis lupus familiaris
FGIAQCSSDVNVPPGS

SEQ ID NO: 9592 - protein, 55 aa, Canis lupus familiaris
FGKPFQRSKFVAKPTSGLWPPGSSITTRLIQRPLRNSLGSKKILPSLPFLGEEEL

SEQ ID NO: 9593 - protein, 10 aa, Canis lupus familiaris
FGKPVKRREI

SEQ ID NO: 9594 - protein, 15 aa, Canis lupus familiaris
FGKSRTAFAQESSGV

SEQ ID NO: 9595 - protein, 35 aa, Canis lupus familiaris
FGLALTCLSAYSIQTSVLLSFIKKSSLPLASWYLM

SEQ ID NO: 9596 - protein, 10 aa, Canis lupus familiaris
FGLKSIKRQS

SEQ ID NO: 9597 - protein, 18 aa, Canis lupus familiaris
FGLVSRKKILNQKCLVPF

SEQ ID NO: 9598 - protein, 20 aa, Canis lupus familiaris
FGLWLVVVPGGAQKGRILEI

SEQ ID NO: 9599 - protein, 20 aa, Canis lupus familiaris
FGMLRKTSNLFQSAGYQRRK

SEQ ID NO: 9600 - protein, 12 aa, Canis lupus familiaris
FGMSVENTLGHN

SEQ ID NO: 9601 - protein, 9 aa, Canis lupus familiaris
FGNAGGQGL

SEQ ID NO: 9602 - protein, 14 aa, Canis lupus familiaris
FGNFMNVLRSSVKM

SEQ ID NO: 9603 - protein, 14 aa, Canis lupus familiaris
FGNGAWTAISYPRK

SEQ ID NO: 9604 - protein, 76 aa, Canis lupus familiaris
FGNQTIPELRTLQTFGGNLITQSLRMVVIMALLRLQKLPERCSAEHLHSGPHCVIGVMALWGSLGERMKITLKTLQ

SEQ ID NO: 9605 - protein, 22 aa, Canis lupus familiaris
FGNRWYGHSSKDHTTYQIYEEI

SEQ ID NO: 9606 - protein, 8 aa, Canis lupus familiaris
FGPVTTET

SEQ ID NO: 9607 - protein, 30 aa, Canis lupus familiaris
FGQDQMWKLKEFSQTSIKCIMVQYHLKKGF

SEQ ID NO: 9608 - protein, 34 aa, Canis lupus familiaris
FGQLQMAGKTPSATISVSWAALRRHQSIFRMGPM

SEQ ID NO: 9609 - protein, 14 aa, Canis lupus familiaris
FGRDPRRPQTLQAS

SEQ ID NO: 9610 - protein, 21 aa, Canis lupus familiaris
FGSASKTWCNQQSINFGRSFL

SEQ ID NO: 9611 - protein, 36 aa, Canis lupus familiaris
FGSNGKRSQITLPNGGILYTYNIWGRCTRLHKGAEE

SEQ ID NO: 9612 - protein, 36 aa, Canis lupus familiaris
FGSNGKRSQITLPNGGILYTYNTWGRCTRLHKGTEE

SEQ ID NO: 9613 - protein, 9 aa, Canis lupus familiaris
FGSQWQGAS

SEQ ID NO: 9614 - protein, 77 aa, Canis lupus familiaris
FGSRMSALSFSNTSKLWKLIACGFPANSLAMICHAMWHCALEKYVSGRTYRRFLAFLPHFPKALGYIKRNCLSVHPY

SEQ ID NO: 9615 - protein, 61 aa, Canis lupus familiaris
FGSSSNLGMKYGIHNQMLVIQREAYIGILLHICTMKLNLIRVIYKIMKIPQCFLSPVFSTS

SEQ ID NO: 9616 - protein, 32 aa, Canis lupus familiaris
FGSVCMEKALPRICVTLWSQLDLALSCCCLCS

SEQ ID NO: 9617 - protein, 14 aa, Canis lupus familiaris
FGTPMLNIRTNTEV

SEQ ID NO: 9618 - protein, 9 aa, Canis lupus familiaris
FGTQSIITL

SEQ ID NO: 9619 - protein, 10 aa, Canis lupus familiaris
FGVQALLNMR

SEQ ID NO: 9620 - protein, 9 aa, Canis lupus familiaris
FGWKRWLFI

SEQ ID NO: 9621 - protein, 19 aa, Canis lupus familiaris
FGWLRSNRKLEIQRCLTCF

SEQ ID NO: 9622 - protein, 14 aa, Canis lupus familiaris
FGWVLFKWIWYPEQ

SEQ ID NO: 9623 - protein, 8 aa, Canis lupus familiaris
FHALLRWH

SEQ ID NO: 9624 - protein, 12 aa, Canis lupus familiaris
FHAYMRLRRKTL

SEQ ID NO: 9625 - protein, 8 aa, Canis lupus familiaris
FHEPKGDV

SEQ ID NO: 9626 - protein, 17 aa, Canis lupus familiaris
FHFLLQLSYAIIIIGIL

SEQ ID NO: 9627 - protein, 8 aa, Canis lupus familiaris
FHFPTKFF

SEQ ID NO: 9628 - protein, 10 aa, Canis lupus familiaris
FHFSIKFFSK

SEQ ID NO: 9629 - protein, 42 aa, Canis lupus familiaris
FHGDVYCICPVWCSVAGMVCLLLERSPENSVLDWCCHLLGNA

SEQ ID NO: 9630 - protein, 82 aa, Canis lupus familiaris
FHGQLLAARVRPEEQPGDVLCRRGRRKRRRRRRGRRRGRRGRRRRRGRRRAAPGVGPRGPAERARGARGGRASWRRRRRHSG

SEQ ID NO: 9631 - protein, 10 aa, Canis lupus familiaris
FHIFLSLKAT

SEQ ID NO: 9632 - protein, 14 aa, Canis lupus familiaris
FHKRKPTKRAESSG

SEQ ID NO: 9633 - protein, 22 aa, Canis lupus familiaris
FHLHCFLGSQKHETTCLQPFEI

SEQ ID NO: 9634 - skipped

SEQ ID NO: 9635 - protein, 36 aa, Canis lupus familiaris
FHLTSQCLFYCKLFGEQGQLLSFWLESLPVQLLSSS

SEQ ID NO: 9636 - protein, 16 aa, Canis lupus familiaris
FHLVCLVPQCLLWILL

SEQ ID NO: 9637 - protein, 13 aa, Canis lupus familiaris
FHNIFSVFIPQAI

SEQ ID NO: 9638 - protein, 18 aa, Canis lupus familiaris
FHNWVGYSNYTSPSYDTS

SEQ ID NO: 9639 - protein, 23 aa, Canis lupus familiaris
FHQQIKMEHQDPIPQDRLWKLKK

SEQ ID NO: 9640 - protein, 36 aa, Canis lupus familiaris
FHRFQAFWLICWRNPCCGGVFIFSSNMAVVHCSRGF

SEQ ID NO: 9641 - protein, 12 aa, Canis lupus familiaris
FHSAAHCSILWT

SEQ ID NO: 9642 - skipped

SEQ ID NO: 9643 - protein, 23 aa, Canis lupus familiaris
FHVWGADSGTEENRERKHNMDPV

SEQ ID NO: 9644 - protein, 10 aa, Canis lupus familiaris
FIAFLSQLFL

SEQ ID NO: 9645 - protein, 10 aa, Canis lupus familiaris
FICLFYLCLF

SEQ ID NO: 9646 - protein, 22 aa, Canis lupus familiaris
FICWWTSAHYSCHCRSHSFRPR

SEQ ID NO: 9647 - protein, 21 aa, Canis lupus familiaris
FIFGVHINCDGKPPHHGHCDL

SEQ ID NO: 9648 - protein, 8 aa, Canis lupus familiaris
FIFPNKTH

SEQ ID NO: 9649 - protein, 11 aa, Canis lupus familiaris
FIFYCNSLMPL

SEQ ID NO: 9650 - protein, 31 aa, Canis lupus familiaris
FIGIMGPYYKLENWSLQIALWRHSRGNSRCI

SEQ ID NO: 9651 - protein, 8 aa, Canis lupus familiaris
FIHYSSLG

SEQ ID NO: 9652 - protein, 60 aa, Canis lupus familiaris
FIICFDTPLSAEAEFSRSCIQSPKYLYFPSHPNFILLHCHCCHFYYPQCNNDSSPHPSSA

SEQ ID NO: 9653 - protein, 10 aa, Canis lupus familiaris
FIIDKIMALY

SEQ ID NO: 9654 - protein, 18 aa, Canis lupus familiaris
FIIGATQTLPMSGQERSW

SEQ ID NO: 9655 - protein, 8 aa, Canis lupus familiaris
FIIGITWI

SEQ ID NO: 9656 - protein, 17 aa, Canis lupus familiaris
FIMRKITLSGNIFQSHT

SEQ ID NO: 9657 - protein, 37 aa, Canis lupus familiaris
FIPRYSVTFCTSWPCSPTRCASRCMSWPWKSSPAMKP

SEQ ID NO: 9658 - protein, 33 aa, Canis lupus familiaris
FIQFWVISSSCKCCHVCEANVAESVRDILLAFG

SEQ ID NO: 9659 - protein, 17 aa, Canis lupus familiaris
FIQTYYLSHSQLRTREN

SEQ ID NO: 9660 - protein, 29 aa, Canis lupus familiaris
FIQYIWILQRSDPNLPTEKELYVGSGQCS

SEQ ID NO: 9661 - protein, 8 aa, Canis lupus familiaris
FIRPRTSS

SEQ ID NO: 9662 - protein, 26 aa, Canis lupus familiaris
FISFGYPHWTLKALVCSQNGVLTWLI

SEQ ID NO: 9663 - protein, 35 aa, Canis lupus familiaris
FISMEVKSKDARVVLFEQTAWTVLIEQIVCRHSLA

SEQ ID NO: 9664 - protein, 23 aa, Canis lupus familiaris
FITIHFHQTKCGIYFQRNWGPCD

SEQ ID NO: 9665 - protein, 14 aa, Canis lupus familiaris
FITMYKDFFTQRNL

SEQ ID NO: 9666 - skipped

SEQ ID NO: 9667 - protein, 20 aa, Canis lupus familiaris
FIYDPQVWPEYTTLYPHPFG

SEQ ID NO: 9668 - protein, 8 aa, Canis lupus familiaris
FIYIIYSI

SEQ ID NO: 9669 - protein, 33 aa, Canis lupus familiaris
FKGNKKLEKYEKYPDWNPQGTAPQHISCNPLCL

SEQ ID NO: 9670 - protein, 15 aa, Canis lupus familiaris
FKIICLPLGVLSPQI

SEQ ID NO: 9671 - protein, 14 aa, Canis lupus familiaris
FKKQKLSLPNIMRK

SEQ ID NO: 9672 - protein, 20 aa, Canis lupus familiaris
FKLRICPMILRMLSCTGLIR

SEQ ID NO: 9673 - protein, 13 aa, Canis lupus familiaris
FKPKAFRLGQVFS

SEQ ID NO: 9674 - protein, 34 aa, Canis lupus familiaris
FKPYSPFCYCVFISGRLYGWRPDLGIWSSGTGTK

SEQ ID NO: 9675 - protein, 65 aa, Canis lupus familiaris
FKQEHRPKCMGPLYLSTFSSVFINPVLGYEIQTRCGTFGKADLKYYKAFADSATTGSVILREAFG

SEQ ID NO: 9676 - protein, 9 aa, Canis lupus familiaris
FKRSSKVPK

SEQ ID NO: 9677 - protein, 9 aa, Canis lupus familiaris
FKSIDIILY

SEQ ID NO: 9678 - protein, 8 aa, Canis lupus familiaris
FKSRRSFK

SEQ ID NO: 9679 - protein, 45 aa, Canis lupus familiaris
FKSYIGPFKLLGSTLDCWNYRLHSEIPLHGLKMPYFVDAFFHHAF

SEQ ID NO: 9680 - protein, 16 aa, Canis lupus familiaris
FKTTRSNASPIVGMLE

SEQ ID NO: 9681 - protein, 48 aa, Canis lupus familiaris
FKVMGMWWSYALTVAGNYPILVLLCLMILSLFKRSLATGPSCSEVRSA

SEQ ID NO: 9682 - protein, 20 aa, Canis lupus familiaris
FLASDSNAPEAEVGICLLCH

SEQ ID NO: 9683 - protein, 30 aa, Canis lupus familiaris
FLAYLHIITSESMMKRQQTFLPTGTKHTIL

SEQ ID NO: 9684 - skipped

SEQ ID NO: 9685 - protein, 43 aa, Canis lupus familiaris
FLCHYIIHFKKSLSRRKTQSPLYLWISYHGYSFIFWAFHLCLP

SEQ ID NO: 9686 - protein, 20 aa, Canis lupus familiaris
FLCLLDYYSWLLVDIFKYIT

SEQ ID NO: 9687 - protein, 45 aa, Canis lupus familiaris
FLCLPLSASEDSTKLESHHLRLPDKLQEFRGLLQLKKKMVIFQTL

SEQ ID NO: 9688 - protein, 18 aa, Canis lupus familiaris
FLCNKCNDGMLFAGNNGL

SEQ ID NO: 9689 - protein, 18 aa, Canis lupus familiaris
FLCNQCNDRMLFAGNNGL

SEQ ID NO: 9690 - protein, 18 aa, Canis lupus familiaris
FLCNQYNDGMLFAGNNGL

SEQ ID NO: 9691 - protein, 33 aa, Canis lupus familiaris
FLCSWELFSSWSSLLGFWHLFSKTGSKTSCISL

SEQ ID NO: 9692 - skipped

SEQ ID NO: 9693 - protein, 20 aa, Canis lupus familiaris
FLDKVTQQSTLLSKLMTHQK

SEQ ID NO: 9694 - skipped

SEQ ID NO: 9695 - protein, 9 aa, Canis lupus familiaris
FLEDLARIP

SEQ ID NO: 9696 - protein, 8 aa, Canis lupus familiaris
FLENTQIP

SEQ ID NO: 9697 - protein, 49 aa, Canis lupus familiaris
FLEQHFQQQIKLPWRKQYLLQHNSWAYNNGQLRKRKSYSFIINCRLVLV

SEQ ID NO: 9698 - protein, 13 aa, Canis lupus familiaris
FLFESNSIFQSFY

SEQ ID NO: 9699 - protein, 37 aa, Canis lupus familiaris
FLFHPPLWPPSTSSCPHCTCKSLPSCAPCSQPPGLWH

SEQ ID NO: 9700 - protein, 21 aa, Canis lupus familiaris
FLFILCWNYLRKPLHYVNSDF

SEQ ID NO: 9701 - protein, 11 aa, Canis lupus familiaris
FLFLCVYLGIY

SEQ ID NO: 9702 - protein, 8 aa, Canis lupus familiaris
FLFQLPWQ

SEQ ID NO: 9703 - skipped

SEQ ID NO: 9704 - protein, 26 aa, Canis lupus familiaris
FLFYFLYRGLAHAIRQVDVWGRRPDA

SEQ ID NO: 9705 - protein, 10 aa, Canis lupus familiaris
FLGFRHRFQK

SEQ ID NO: 9706 - protein, 18 aa, Canis lupus familiaris
FLGGWIWSPDCICQLQQI

SEQ ID NO: 9707 - protein, 11 aa, Canis lupus familiaris
FLGNSSGTIHE

SEQ ID NO: 9708 - protein, 16 aa, Canis lupus familiaris
FLGSNYEMGVGVCRIG

SEQ ID NO: 9709 - protein, 13 aa, Canis lupus familiaris
FLHHFLEKSPLEE

SEQ ID NO: 9710 - protein, 21 aa, Canis lupus familiaris
FLHVCYSFCLQHGSFSRLQIF

SEQ ID NO: 9711 - protein, 10 aa, Canis lupus familiaris
FLIFPCLNLT

SEQ ID NO: 9712 - skipped

SEQ ID NO: 9713 - protein, 10 aa, Canis lupus familiaris
FLIQRIWSVC

SEQ ID NO: 9714 - protein, 30 aa, Canis lupus familiaris
FLKPFMRYPRFFMEKTCLPQYPLAVRLLEK

SEQ ID NO: 9715 - protein, 72 aa, Canis lupus familiaris
FLLFCPVLARHLSLLNWGIVQRHHPLNLLLSSLSHLPLWLPFPHPRQLKTGPPQTRARPVLKNHLCSIRQNC

SEQ ID NO: 9716 - protein, 18 aa, Canis lupus familiaris
FLLFEVVAGCEEKIDFVA

SEQ ID NO: 9717 - protein, 9 aa, Canis lupus familiaris
FLLFKREIE

SEQ ID NO: 9718 - protein, 10 aa, Canis lupus familiaris
FLLLLFLMSM

SEQ ID NO: 9719 - protein, 14 aa, Canis lupus familiaris
FLLLVFELSSIEVP

SEQ ID NO: 9720 - protein, 9 aa, Canis lupus familiaris
FLLPRSGGH

SEQ ID NO: 9721 - protein, 29 aa, Canis lupus familiaris
FLLQPPFWTCITLCSYSLVYHLSACAACP

SEQ ID NO: 9722 - skipped

SEQ ID NO: 9723 - protein, 55 aa, Canis lupus familiaris
FLLYVYPLHHLENELSYRETQSLFHLLSTSDRGDHILWYHLLHVCQAQVSRPPRE

SEQ ID NO: 9724 - protein, 22 aa, Canis lupus familiaris
FLMEYRVQSRPSSGNQVQLLWL

SEQ ID NO: 9725 - protein, 47 aa, Canis lupus familiaris
FLMILVCILICMPEHTSTLKTKRTLFCSGIALMVMYSLTIKVRNILL

SEQ ID NO: 9726 - protein, 11 aa, Canis lupus familiaris
FLMLPTLGKTV

SEQ ID NO: 9727 - protein, 9 aa, Canis lupus familiaris
FLMSLYYSL

SEQ ID NO: 9728 - protein, 14 aa, Canis lupus familiaris
FLNCENVLKPKASS

SEQ ID NO: 9729 - protein, 12 aa, Canis lupus familiaris
FLNMNLHMSWLQ

SEQ ID NO: 9730 - protein, 11 aa, Canis lupus familiaris
FLPDCHLPGDS

SEQ ID NO: 9731 - protein, 28 aa, Canis lupus familiaris
FLPEGPIPAKTGGEKAHGICSKRWNSIL

SEQ ID NO: 9732 - protein, 18 aa, Canis lupus familiaris
FLPILTMPLKKLILYLFL

SEQ ID NO: 9733 - protein, 42 aa, Canis lupus familiaris
FLPPDSCGEPHYHHYLIPTSPPPHPYVLLPQQPLPAGPLLHY

SEQ ID NO: 9734 - protein, 10 aa, Canis lupus familiaris
FLQLPLPGTL

SEQ ID NO: 9735 - protein, 97 aa, Canis lupus familiaris
FLQPPYWSQSQPCPEPLEAVPLTGHLPAGGERKLFHIHGFPGPGAHFSTPRRPRDAGRTGAFGQGPERGPQWKRGPLCRVWGQRFVPALRRPHLRGL

SEQ ID NO: 9736 - protein, 54 aa, Canis lupus familiaris
FLQSHVPKSCLSRRESMWMVVQYSSKQKNLHWCKSIQWNLTKWQWLIQMDPKLC

SEQ ID NO: 9737 - protein, 18 aa, Canis lupus familiaris
FLRDLCWWGIINSFLPWC

SEQ ID NO: 9738 - protein, 27 aa, Canis lupus familiaris
FLRFTLCWFMEPGPSCSYTRRTPSSWS

SEQ ID NO: 9739 - skipped

SEQ ID NO: 9740 - protein, 8 aa, Canis lupus familiaris
FLRKNGNY

SEQ ID NO: 9741 - protein, 48 aa, Canis lupus familiaris
FLRMMKDLVVLIYSGEEWEVILAGILGRLEQTTCEWTVGRNIKMPKGE

SEQ ID NO: 9742 - protein, 9 aa, Canis lupus familiaris
FLRYRTWCS

SEQ ID NO: 9743 - protein, 9 aa, Canis lupus familiaris
FLSALRWYF

SEQ ID NO: 9744 - protein, 33 aa, Canis lupus familiaris
FLSFCCSHSPCSHFLSPWSYTQKDAVSEDGWSL

SEQ ID NO: 9745 - protein, 30 aa, Canis lupus familiaris
FLSISYHQDLATHLWRILQQVLSWSSAQSR

SEQ ID NO: 9746 - protein, 64 aa, Canis lupus familiaris
FLSLPSRARGCEPARGGVCERPAPARRGEAAHRGAGPPGRAALRHIPAAARQPRLCQQNPGQVL

SEQ ID NO: 9747 - protein, 9 aa, Canis lupus familiaris
FLSMGFLRT

SEQ ID NO: 9748 - protein, 18 aa, Canis lupus familiaris
FLSMSPGCSHPLWLIPQY

SEQ ID NO: 9749 - protein, 8 aa, Canis lupus familiaris
FLSSPTVS

SEQ ID NO: 9750 - protein, 21 aa, Canis lupus familiaris
FLTFIRNRYKWTCSPTNIEGI

SEQ ID NO: 9751 - protein, 21 aa, Canis lupus familiaris
FLTFYIMSSVKITPWCLELCP

SEQ ID NO: 9752 - protein, 19 aa, Canis lupus familiaris
FLTSEEWRSLTMPLLTSTQ

SEQ ID NO: 9753 - skipped

SEQ ID NO: 9754 - protein, 20 aa, Canis lupus familiaris
FLVKSMLAVRTDRWRPALWS

SEQ ID NO: 9755 - protein, 9 aa, Canis lupus familiaris
FLVPLSFLP

SEQ ID NO: 9756 - protein, 13 aa, Canis lupus familiaris
FLVSGFLLKSTVW

SEQ ID NO: 9757 - protein, 11 aa, Canis lupus familiaris
FLVSPQQGTGV

SEQ ID NO: 9758 - protein, 17 aa, Canis lupus familiaris
FLVSQNSIPFFSNSWKL

SEQ ID NO: 9759 - protein, 13 aa, Canis lupus familiaris
FLVSVCLPWHILK

SEQ ID NO: 9760 - protein, 9 aa, Canis lupus familiaris
FLWLCSRIL

SEQ ID NO: 9761 - protein, 19 aa, Canis lupus familiaris
FLWPFKKKPNKRTGRYFVL

SEQ ID NO: 9762 - protein, 25 aa, Canis lupus familiaris
FLWSNHVCLYMATPQFPDGQISCSL

SEQ ID NO: 9763 - protein, 25 aa, Canis lupus familiaris
FLWYCCRTRMWFTVHGNSDHYVPVF

SEQ ID NO: 9764 - protein, 16 aa, Canis lupus familiaris
FLYLCKQILGSRKIKI

SEQ ID NO: 9765 - protein, 43 aa, Canis lupus familiaris
FLYLKTLLPGHLSLKVELISLERSRSNKRIRGSTFLPTWQNWL

SEQ ID NO: 9766 - protein, 34 aa, Canis lupus familiaris
FLYNIFDFNAKRSKYSIFQRGIKDGKKYKQKQDV

SEQ ID NO: 9767 - protein, 20 aa, Canis lupus familiaris
FLYPRDRGISQSRCICRVGL

SEQ ID NO: 9768 - protein, 21 aa, Canis lupus familiaris
FMAMKRLVGHLHLMNSQEKLK

SEQ ID NO: 9769 - protein, 40 aa, Canis lupus familiaris
FMCTTSLKGSAPPCFGISNRSPSALAFWSYVYLTPSCQVC

SEQ ID NO: 9770 - protein, 37 aa, Canis lupus familiaris
FMLLYKRERNLVLLVGIFHTDLMNPTYASVSDNYSYL

SEQ ID NO: 9771-9772 - skipped (2 entries)

SEQ ID NO: 9773 - protein, 14 aa, Canis lupus familiaris
FMPSHPFVRFVCLF

SEQ ID NO: 9774 - protein, 25 aa, Canis lupus familiaris
FMPVYQQIHWRLYPKLFAGLFPQEL

SEQ ID NO: 9775 - skipped

SEQ ID NO: 9776 - protein, 26 aa, Canis lupus familiaris
FMSRKPRFKRTDSSSTGRASGASYRA

SEQ ID NO: 9777 - protein, 20 aa, Canis lupus familiaris
FMTFFGETGMMKKVVRITLL

SEQ ID NO: 9778 - protein, 30 aa, Canis lupus familiaris
FMWTDHPRCPDGLQSWQRKMTGQTAVWSPL

SEQ ID NO: 9779 - protein, 37 aa, Canis lupus familiaris
FNALDIFLKSQNMKEILRLNYFLDLTGRTFDSMSHLW

SEQ ID NO: 9780 - protein, 70 aa, Canis lupus familiaris
FNGCVHYCWFFDPYNHLLHLHHFHHPQDSLSLWAEESLFYVCVPLHLCRDRVWHLLVPLCETQANTGSRV

SEQ ID NO: 9781 - protein, 34 aa, Canis lupus familiaris
FNKPMYIDFWDGKPTYVLLKQSYVIFIFGHFCAW

SEQ ID NO: 9782 - protein, 12 aa, Canis lupus familiaris
FNLGKPDCWGKR

SEQ ID NO: 9783 - protein, 14 aa, Canis lupus familiaris
FNLQILFCKYFGKH

SEQ ID NO: 9784 - protein, 16 aa, Canis lupus familiaris
FNPDWSLQCGTGCSMY

SEQ ID NO: 9785 - protein, 32 aa, Canis lupus familiaris
FNRAADGAAILALRLPLQPIPGACGAKPWVDS

SEQ ID NO: 9786 - protein, 10 aa, Canis lupus familiaris
FNRRRSKETT

SEQ ID NO: 9787 - protein, 9 aa, Canis lupus familiaris
FNSKISTGL

SEQ ID NO: 9788 - protein, 14 aa, Canis lupus familiaris
FPAMYSLICKHLAS

SEQ ID NO: 9789 - protein, 89 aa, Canis lupus familiaris
FPARGRVREAQEEGSVSLSHGREKAVQVQQGLHRGLGGVPGQASSQACGGQSSQHAHGSPKAQPLPLRPMESQVPAPFHVVPPQRTSCL

SEQ ID NO: 9790 - protein, 8 aa, Canis lupus familiaris
FPCSTWDH

SEQ ID NO: 9791 - protein, 15 aa, Canis lupus familiaris
FPEQTEGDRGGGGPV

SEQ ID NO: 9792 - protein, 17 aa, Canis lupus familiaris
FPFLTYCLLAKFGLFFP

SEQ ID NO: 9793 - skipped

SEQ ID NO: 9794 - protein, 12 aa, Canis lupus familiaris
FPGDLFGDVPSS

SEQ ID NO: 9795 - protein, 23 aa, Canis lupus familiaris
FPGTCCGSKNPARKHWCVELHKP

SEQ ID NO: 9796 - protein, 91 aa, Canis lupus familiaris
FPHGLLALDHLPGGRGTLQGYHQIPHRDWDWPFRVGPLLPQQQGGKKQKNSLGPKNCSIHYMVPPGPMYVSCCRDGFGRWRRDAQATRSQV

SEQ ID NO: 9797 - skipped

SEQ ID NO: 9798 - protein, 19 aa, Canis lupus familiaris
FPIHFGNCSCNPDKCKVPV

SEQ ID NO: 9799 - protein, 13 aa, Canis lupus familiaris
FPIHFGNCSCNPG

SEQ ID NO: 9800 - protein, 24 aa, Canis lupus familiaris
FPIHVARMFSSFVAYPSVLRKERQ

SEQ ID NO: 9801 - protein, 10 aa, Canis lupus familiaris
FPIHWKPIYF

SEQ ID NO: 9802 - protein, 13 aa, Canis lupus familiaris
FPKASTVCFYLFW

SEQ ID NO: 9803 - protein, 32 aa, Canis lupus familiaris
FPKIHLFPKCWNMKEIRELMLENLPIDSSWIT

SEQ ID NO: 9804 - protein, 49 aa, Canis lupus familiaris
FPLGIVRTTAMKYVNNLLKSWETVVLLKLLIQKSSNSTVQDFSCHFIPL

SEQ ID NO: 9805 - protein, 28 aa, Canis lupus familiaris
FPLQSVQRQNAFCWQQWLMIAMWPYANH

SEQ ID NO: 9806 - skipped

SEQ ID NO: 9807 - protein, 18 aa, Canis lupus familiaris
FPMVLLSDSDVVYCTRQQ

SEQ ID NO: 9808 - protein, 16 aa, Canis lupus familiaris
FPPDSLGLRSFIFEKV

SEQ ID NO: 9809 - protein, 39 aa, Canis lupus familiaris
FPPGHPRSGTISPVALTPRVLPGHSHNCGQHYHPGCCCH

SEQ ID NO: 9810 - protein, 15 aa, Canis lupus familiaris
FPPGKAASMTSSGSS

SEQ ID NO: 9811 - protein, 79 aa, Canis lupus familiaris
FPPIREEVHLSFPTWPLPGGGPRLDPSGLSGCTERPCGKDRGPEALHVLHRPEQGPADGLCQVLRYLPSAAARRGITPV

SEQ ID NO: 9812 - protein, 39 aa, Canis lupus familiaris
FPPIREEVHLSFPTWPLPGGGPRVCTWRLPGYHDGRDFF

SEQ ID NO: 9813 - protein, 57 aa, Canis lupus familiaris
FPPRMAEFSDVEKLFTRDLLWASVPSRAESSEVVLHKRAERRTGVADSQSGKSTIVR

SEQ ID NO: 9814 - protein, 23 aa, Canis lupus familiaris
FPRHPQFAFTSFGDCYRRKQRYI

SEQ ID NO: 9815 - protein, 23 aa, Canis lupus familiaris
FPRKQQCKNKICRSCEEGQAYTR

SEQ ID NO: 9816 - protein, 14 aa, Canis lupus familiaris
FPRLKKPRGNTERV

SEQ ID NO: 9817 - protein, 15 aa, Canis lupus familiaris
FPRNLKLILMTFSKI

SEQ ID NO: 9818 - protein, 12 aa, Canis lupus familiaris
FPSALLSGESEA

SEQ ID NO: 9819 - protein, 17 aa, Canis lupus familiaris
FPSAPLLVPVPALPRAP

SEQ ID NO: 9820 - protein, 15 aa, Canis lupus familiaris
FPSDLGSIPKRVCHC

SEQ ID NO: 9821 - skipped

SEQ ID NO: 9822 - protein, 36 aa, Canis lupus familiaris
FPSSATVLDMYHPMFIFSCLPSICLCRLPLTPLSMV

SEQ ID NO: 9823 - protein, 39 aa, Canis lupus familiaris
FPSSKQCLEPNPLHSHNQLFQGQVETAAAQTSEEIYFQN

SEQ ID NO: 9824 - protein, 17 aa, Canis lupus familiaris
FPSSWVYRKFPPSSDVL

SEQ ID NO: 9825 - protein, 59 aa, Canis lupus familiaris
FPSSYWDSCWCQYLRRFGGSPRCHPQRNHAGHFHHHCRLYRSCYLCRGLCGPRCYRKHE

SEQ ID NO: 9826 - protein, 49 aa, Canis lupus familiaris
FPSVLISPVSVNLQCIIDLRTVCPVILAHRSTSLMAVSHRTSSPVGIDH

SEQ ID NO: 9827 - protein, 8 aa, Canis lupus familiaris
FPSWICCC

SEQ ID NO: 9828 - protein, 8 aa, Canis lupus familiaris
FPVLVATV

SEQ ID NO: 9829 - skipped

SEQ ID NO: 9830 - protein, 14 aa, Canis lupus familiaris
FPVQDNIPRWTDSI

SEQ ID NO: 9831 - protein, 13 aa, Canis lupus familiaris
FPVWVCKRSEDCK

SEQ ID NO: 9832 - protein, 18 aa, Canis lupus familiaris
FPVWVIIYIFCFNADTSF

SEQ ID NO: 9833 - protein, 24 aa, Canis lupus familiaris
FPVYINLCFASLHRMKAVMLVALQ

SEQ ID NO: 9834 - protein, 9 aa, Canis lupus familiaris
FPWGLDLES

SEQ ID NO: 9835-9836 - skipped (2 entries)

SEQ ID NO: 9837 - protein, 8 aa, Canis lupus familiaris
FQEIVKST

SEQ ID NO: 9838 - protein, 25 aa, Canis lupus familiaris
FQEQLNMSSKILYMTQKDTRCSSVI

SEQ ID NO: 9839 - protein, 28 aa, Canis lupus familiaris
FQIQVLRVVIHLKIACLLNIIIILILIQ

SEQ ID NO: 9840 - protein, 42 aa, Canis lupus familiaris
FQIVHTLKISDMWKIYKNQFYTFCTNIQKFIIRKTYNILLIS

SEQ ID NO: 9841 - protein, 16 aa, Canis lupus familiaris
FQKALETKLLHIHFML

SEQ ID NO: 9842 - protein, 12 aa, Canis lupus familiaris
FQKSTYFRNVGT

SEQ ID NO: 9843 - protein, 16 aa, Canis lupus familiaris
FQLEEEPLSSAGYSLC

SEQ ID NO: 9844 - protein, 13 aa, Canis lupus familiaris
FQLLKYWSRTIHP

SEQ ID NO: 9845 - protein, 29 aa, Canis lupus familiaris
FQLQDIHWIIEENWNVLGCSECHQAVWQN

SEQ ID NO: 9846 - protein, 21 aa, Canis lupus familiaris
FQLTLVVSTSKKSFLLMIQRI

SEQ ID NO: 9847 - protein, 35 aa, Canis lupus familiaris
FQPSQLNRTVPGTEFPDCCTSKPSRHKPEEALSSR

SEQ ID NO: 9848 - protein, 13 aa, Canis lupus familiaris
FQQSMEIRQHVLM

SEQ ID NO: 9849 - skipped

SEQ ID NO: 9850 - protein, 19 aa, Canis lupus familiaris
FQRPFRCADRGRSFHRERF

SEQ ID NO: 9851 - protein, 37 aa, Canis lupus familiaris
FQSEYCCSKANSTKKPGNINKRISCVIWISTSKKRSR

SEQ ID NO: 9852 - protein, 22 aa, Canis lupus familiaris
FQSFAAKNISPAFDFIVAHNGL

SEQ ID NO: 9853 - protein, 25 aa, Canis lupus familiaris
FQSIWCLLQLKPMVKYPPHRFCRCF

SEQ ID NO: 9854-9855 - skipped (2 entries)

SEQ ID NO: 9856 - protein, 9 aa, Canis lupus familiaris
FQWKNTKEH

SEQ ID NO: 9857 - protein, 26 aa, Canis lupus familiaris
FQYILKQVLSQRRQGNWTESSKMNIY

SEQ ID NO: 9858 - protein, 12 aa, Canis lupus familiaris
FQYLPLTLSLSG

SEQ ID NO: 9859 - protein, 13 aa, Canis lupus familiaris
FRASVCWVTVYFP

SEQ ID NO: 9860 - protein, 9 aa, Canis lupus familiaris
FRAVRKLRF

SEQ ID NO: 9861 - protein, 19 aa, Canis lupus familiaris
FRHCLWLFKKKVMGLFTVV

SEQ ID NO: 9862 - protein, 30 aa, Canis lupus familiaris
FRLCWSAQMGIFSQFKTIISSCPWVCKREF

SEQ ID NO: 9863 - protein, 16 aa, Canis lupus familiaris
FRRFHIIIILKRFLKT

SEQ ID NO: 9864 - skipped

SEQ ID NO: 9865 - protein, 10 aa, Canis lupus familiaris
FRSKSLYYSL

SEQ ID NO: 9866 - protein, 34 aa, Canis lupus familiaris
FRSLMPPRMGPSAPVTSTISDRASRGPVPVAMSD

SEQ ID NO: 9867 - protein, 9 aa, Canis lupus familiaris
FRSPSTTTF

SEQ ID NO: 9868 - protein, 37 aa, Canis lupus familiaris
FRSRLHSDRSSNMVGRLFHDGHSPDAEKKENALHPGL

SEQ ID NO: 9869 - protein, 14 aa, Canis lupus familiaris
FRSSDFYVFGASLF

SEQ ID NO: 9870 - protein, 41 aa, Canis lupus familiaris
FRTLACCGTWRSSKRKNSGNLRSSSNKNLCNLASSQSHGLS

SEQ ID NO: 9871 - protein, 34 aa, Canis lupus familiaris
FRVERQKVTNYITQWWNIVYLQHLGKMYETSQRC

SEQ ID NO: 9872 - protein, 34 aa, Canis lupus familiaris
FRVERQKVTNYITQWWNIVYLQHLGKMYETSQRY

SEQ ID NO: 9873 - protein, 38 aa, Canis lupus familiaris
FRVSRCHEFQRESEESHLPLGGTFILPLFFKNCFGSCI

SEQ ID NO: 9874 - protein, 30 aa, Canis lupus familiaris
FRVSRCHEFQRESVESHLPLRGTFILPLFF

SEQ ID NO: 9875 - protein, 9 aa, Canis lupus familiaris
FRYIKRHDL

SEQ ID NO: 9876 - protein, 8 aa, Canis lupus familiaris
FRYISKSI

SEQ ID NO: 9877 - protein, 19 aa, Canis lupus familiaris
FSACLCQPQRIQPNWKAIT

SEQ ID NO: 9878 - protein, 12 aa, Canis lupus familiaris
FSCFQHLERQSN

SEQ ID NO: 9879 - protein, 12 aa, Canis lupus familiaris
FSCMGYHLYFLL

SEQ ID NO: 9880 - protein, 24 aa, Canis lupus familiaris
FSCTLDQICLNKGIKISQLLFCLQ

SEQ ID NO: 9881 - skipped

SEQ ID NO: 9882 - protein, 36 aa, Canis lupus familiaris
FSCVGCHCIVPTRGVPSTALVHTAHFQERQSLSSTC

SEQ ID NO: 9883-9884 - skipped (2 entries)

SEQ ID NO: 9885 - protein, 27 aa, Canis lupus familiaris
FSFFPALIPTTRLTFVSKLWRYPFMRL

SEQ ID NO: 9886 - protein, 18 aa, Canis lupus familiaris
FSFFSLVKLIILIPWSPN

SEQ ID NO: 9887 - protein, 24 aa, Canis lupus familiaris
FSFLLSLPWARPCHTSSGCLGPKT

SEQ ID NO: 9888 - protein, 8 aa, Canis lupus familiaris
FSFPQVKI

SEQ ID NO: 9889 - skipped

SEQ ID NO: 9890 - protein, 14 aa, Canis lupus familiaris
FSFSAPLAIIMALQ

SEQ ID NO: 9891 - protein, 26 aa, Canis lupus familiaris
FSFWKVSCMSMQHTLWIACGTVLPSY

SEQ ID NO: 9892 - protein, 8 aa, Canis lupus familiaris
FSFYFIWN

SEQ ID NO: 9893 - protein, 19 aa, Canis lupus familiaris
FSFYFRMLMIGMGHQIIMG

SEQ ID NO: 9894 - protein, 30 aa, Canis lupus familiaris
FSGELDLCNVSPRRCPRKSVEMDCVCSSIN

SEQ ID NO: 9895 - protein, 21 aa, Canis lupus familiaris
FSGNTKLSQPSWNTMTPGKVL

SEQ ID NO: 9896 - protein, 15 aa, Canis lupus familiaris
FSGRTPRSIDPVLHF

SEQ ID NO: 9897 - protein, 11 aa, Canis lupus familiaris
FSGSQQMRLGT

SEQ ID NO: 9898 - protein, 18 aa, Canis lupus familiaris
FSIFMGLAGECPLALSAS

SEQ ID NO: 9899 - protein, 25 aa, Canis lupus familiaris
FSIKCLAECFSWCYSTKYSLQNQCC

SEQ ID NO: 9900 - protein, 18 aa, Canis lupus familiaris
FSIRPGLNSQESVPLLRP

SEQ ID NO: 9901 - protein, 88 aa, Canis lupus familiaris
FSKGRCLWWSCRISWLRNLLKPSLQRHLHTRACPLRVRCWSLALKKTLFLATHPGVLPLLPAHLRGSLLPKSSTAVPGPSPPPHLSAE

SEQ ID NO: 9902 - protein, 48 aa, Canis lupus familiaris
FSKRPGRSPRTQSGPQDEDDIDTQSVGAGASEAARDCLPRTRGQTFPL

SEQ ID NO: 9903 - protein, 10 aa, Canis lupus familiaris
FSKVTCQNHV

SEQ ID NO: 9904 - protein, 15 aa, Canis lupus familiaris
FSLCYMSSLCWETFS

SEQ ID NO: 9905 - protein, 9 aa, Canis lupus familiaris
FSLEIYLCS

SEQ ID NO: 9906 - protein, 14 aa, Canis lupus familiaris
FSLPLKIKTSIGKM

SEQ ID NO: 9907 - protein, 16 aa, Canis lupus familiaris
FSLPLQANTWKQKDQN

SEQ ID NO: 9908 - protein, 15 aa, Canis lupus familiaris
FSLRCTLQHTMDMNR

SEQ ID NO: 9909 - skipped

SEQ ID NO: 9910 - protein, 10 aa, Canis lupus familiaris
FSLYSMLELS

SEQ ID NO: 9911 - protein, 25 aa, Canis lupus familiaris
FSMFAIHFVYSMDPSVAFRYFRVAS

SEQ ID NO: 9912 - protein, 15 aa, Canis lupus familiaris
FSNIISLIEDNQKKN

SEQ ID NO: 9913 - protein, 26 aa, Canis lupus familiaris
FSNLHDSGNLVKQPCHCYSHEGLSEI

SEQ ID NO: 9914 - protein, 44 aa, Canis lupus familiaris
FSNPLETHLFLDAWMGYSLMEMTKEYQKLYTDLAMGGIDLVPSK

SEQ ID NO: 9915 - protein, 25 aa, Canis lupus familiaris
FSPFSGFLAHMLEESLLRGCFHFLV

SEQ ID NO: 9916 - protein, 11 aa, Canis lupus familiaris
FSPHFSVWMST

SEQ ID NO: 9917 - protein, 11 aa, Canis lupus familiaris
FSPICLSSTPS

SEQ ID NO: 9918 - protein, 11 aa, Canis lupus familiaris
FSPICSSSTPS

SEQ ID NO: 9919 - protein, 23 aa, Canis lupus familiaris
FSPTASSWHSMTRSFSSSTWCCC

SEQ ID NO: 9920 - skipped

SEQ ID NO: 9921 - protein, 35 aa, Canis lupus familiaris
FSQELQLSIAVSQKATLFISTEMKEVSSILPPPGM

SEQ ID NO: 9922 - protein, 30 aa, Canis lupus familiaris
FSQFRFLCFWCIALLKMLWFPSNLFQTYIS

SEQ ID NO: 9923 - protein, 36 aa, Canis lupus familiaris
FSQHFFCLHSSSNLRLSGIFLPRCDRQSVILLYFSQ

SEQ ID NO: 9924 - protein, 23 aa, Canis lupus familiaris
FSQLDLLLLSEYYMFLAWGSVFW

SEQ ID NO: 9925 - protein, 15 aa, Canis lupus familiaris
FSQLGWLFQLHFTFI

SEQ ID NO: 9926 - skipped

SEQ ID NO: 9927 - protein, 9 aa, Canis lupus familiaris
FSQRQPMRR

SEQ ID NO: 9928 - protein, 37 aa, Canis lupus familiaris
FSQVVSWWSSTTTSSSRPCRAAQGPWRQDGHHLPPHN

SEQ ID NO: 9929 - protein, 19 aa, Canis lupus familiaris
FSREIISEVVSFHFPSLHQ

SEQ ID NO: 9930 - protein, 10 aa, Canis lupus familiaris
FSRNLLLTCC

SEQ ID NO: 9931 - protein, 58 aa, Canis lupus familiaris
FSRTDRGGQRRWWTCIMECAYKDLQGCLGEMEALGPMAFLVPLGSQVEMDSKEKRGNA

SEQ ID NO: 9932 - protein, 15 aa, Canis lupus familiaris
FSSHFSVLVLLQIVW

SEQ ID NO: 9933 - protein, 65 aa, Canis lupus familiaris
FSSHFSVLVLLQIVWGAGAVAVLLAGEPSSPTAIFLLMTTRPGLRVKGTARVWGLTWPPSAQKLS

SEQ ID NO: 9934 - protein, 40 aa, Canis lupus familiaris
FSSHHYIYVLLAERAVGSVDGGELHAWALGEKHHISPACI

SEQ ID NO: 9935 - protein, 12 aa, Canis lupus familiaris
FSSILTKMFAYW

SEQ ID NO: 9936 - protein, 9 aa, Canis lupus familiaris
FSSLHLTKK

SEQ ID NO: 9937 - protein, 37 aa, Canis lupus familiaris
FSSMKRLTICGMEALRPKQEKNLNTCFPSLHCAGLSL

SEQ ID NO: 9938 - protein, 8 aa, Canis lupus familiaris
FSSPRTGS

SEQ ID NO: 9939 - protein, 32 aa, Canis lupus familiaris
FSSRDRRTGTRGRSLCQINLPVPIPRNHDQMD

SEQ ID NO: 9940 - protein, 28 aa, Canis lupus familiaris
FSSRRPDTSENRRRESPWNLLQEMEFYS

SEQ ID NO: 9941 - protein, 8 aa, Canis lupus familiaris
FSSSRQHP

SEQ ID NO: 9942 - protein, 28 aa, Canis lupus familiaris
FSSTPLISPLCVQLKSSPLVIELKNSNR

SEQ ID NO: 9943 - skipped

SEQ ID NO: 9944 - protein, 24 aa, Canis lupus familiaris
FSTHPRRSPSVFSNLAPTWRGPPA

SEQ ID NO: 9945 - protein, 33 aa, Canis lupus familiaris
FSTHPRRSPSVFSNLAPTWRGPPGLHMEAPWLP

SEQ ID NO: 9946 - protein, 12 aa, Canis lupus familiaris
FSTQTLDKVSKP

SEQ ID NO: 9947 - protein, 8 aa, Canis lupus familiaris
FSTSIPLC

SEQ ID NO: 9948 - protein, 54 aa, Canis lupus familiaris
FSTVVIFSTSEFLQPTSIFLKLNLKLTHLWTPVNGRHLISTVCISVCSEAGCSP

SEQ ID NO: 9949 - protein, 23 aa, Canis lupus familiaris
FSTYAVQLYLFNTELLGHELDQT

SEQ ID NO: 9950 - protein, 12 aa, Canis lupus familiaris
FSVSLPILSAMC

SEQ ID NO: 9951 - protein, 37 aa, Canis lupus familiaris
FSVYLTWPTWTPCTSTPWSGFSTSSAQASPTRRGQTT

SEQ ID NO: 9952 - protein, 34 aa, Canis lupus familiaris
FSWKQLWDNSRVRVALRVGGKFALYLKASAMQHK

SEQ ID NO: 9953 - protein, 21 aa, Canis lupus familiaris
FSWNLLWVKESGEEALVCGIT

SEQ ID NO: 9954-9955 - skipped (2 entries)

SEQ ID NO: 9956 - protein, 8 aa, Canis lupus familiaris
FSYRFIDL

SEQ ID NO: 9957 - protein, 16 aa, Canis lupus familiaris
FSYSKNLECVLRKSRH

SEQ ID NO: 9958 - protein, 19 aa, Canis lupus familiaris
FSYTFWELQLQSRLKNLLY

SEQ ID NO: 9959 - protein, 29 aa, Canis lupus familiaris
FSYTFWELQLQSRQMQGSCLIIPNQLLIL

SEQ ID NO: 9960 - skipped

SEQ ID NO: 9961 - protein, 30 aa, Canis lupus familiaris
FTCCEKRSNPIISLGELLFLGFGIAEFKLL

SEQ ID NO: 9962 - protein, 13 aa, Canis lupus familiaris
FTHWCLTLCRRHF

SEQ ID NO: 9963 - protein, 35 aa, Canis lupus familiaris
FTIILSTTFQQQQVNTMAPTSAGGLSGRKTSLRRL

SEQ ID NO: 9964 - protein, 28 aa, Canis lupus familiaris
FTKRRGGCVSTSAAWSKLRPSTGLCSVW

SEQ ID NO: 9965 - protein, 8 aa, Canis lupus familiaris
FTLQIFNF

SEQ ID NO: 9966 - protein, 60 aa, Canis lupus familiaris
FTMLQITIKVCPRLFRKDASGQTGFLYSVTTLHFSIYLFLPESKRSVCSCTSQLALEVYN

SEQ ID NO: 9967 - protein, 12 aa, Canis lupus familiaris
FTPCPLPFLCKI

SEQ ID NO: 9968 - protein, 13 aa, Canis lupus familiaris
FTRKQIKFSSGAF

SEQ ID NO: 9969 - protein, 25 aa, Canis lupus familiaris
FTRTYMNKQLERKTRKRRQLLKVTV

SEQ ID NO: 9970 - protein, 11 aa, Canis lupus familiaris
FTRVQKRERNS

SEQ ID NO: 9971 - protein, 22 aa, Canis lupus familiaris
FTSCFPDGFPTPSTQYPPSPEA

SEQ ID NO: 9972 - protein, 10 aa, Canis lupus familiaris
FTSFHLFHTA

SEQ ID NO: 9973 - protein, 22 aa, Canis lupus familiaris
FTSHLDKQKSKTGPKRRPLPAF

SEQ ID NO: 9974 - protein, 24 aa, Canis lupus familiaris
FTSLLTLSGGAPLMRSIYCTFHTT

SEQ ID NO: 9975 - protein, 14 aa, Canis lupus familiaris
FTTSSAALSVCSTR

SEQ ID NO: 9976 - skipped

SEQ ID NO: 9977 - protein, 8 aa, Canis lupus familiaris
FTVVGKKR

SEQ ID NO: 9978 - protein, 19 aa, Canis lupus familiaris
FTWFAWCHNAYYGFYCSSW

SEQ ID NO: 9979 - protein, 17 aa, Canis lupus familiaris
FTWIYYKNRWNILHPNS

SEQ ID NO: 9980 - protein, 12 aa, Canis lupus familiaris
FTWTWRHRAQLG

SEQ ID NO: 9981 - protein, 14 aa, Canis lupus familiaris
FTYQNSCSIPTTLI

SEQ ID NO: 9982 - protein, 16 aa, Canis lupus familiaris
FVAACWCGTIRIRTTT

SEQ ID NO: 9983 - protein, 16 aa, Canis lupus familiaris
FVDSSSYRRFKTNQDI

SEQ ID NO: 9984 - protein, 35 aa, Canis lupus familiaris
FVESAVILMRTMEMGKIFSQNFKKFRTLRNPRMRK

SEQ ID NO: 9985 - protein, 25 aa, Canis lupus familiaris
FVEYQSAAEDHNTSPSRSYGKRRKQ

SEQ ID NO: 9986 - protein, 14 aa, Canis lupus familiaris
FVFCFFFSKLQEDR

SEQ ID NO: 9987 - protein, 9 aa, Canis lupus familiaris
FVFFFFFCP

SEQ ID NO: 9988 - protein, 18 aa, Canis lupus familiaris
FVFGCGLMCLLQRWLFVQ

SEQ ID NO: 9989 - protein, 17 aa, Canis lupus familiaris
FVFGLSSYGNQPRKSVQ

SEQ ID NO: 9990 - protein, 19 aa, Canis lupus familiaris
FVFHPMHVSVRLAFSPTFN

SEQ ID NO: 9991 - protein, 11 aa, Canis lupus familiaris
FVFLLFLNAMC

SEQ ID NO: 9992 - protein, 46 aa, Canis lupus familiaris
FVFYYILHSKYARKPSHCGHYHLRPSLTFTYVFFAGKSFHHRHRCF

SEQ ID NO: 9993 - protein, 12 aa, Canis lupus familiaris
FVGCSAGHYDPD

SEQ ID NO: 9994 - protein, 17 aa, Canis lupus familiaris
FVISSTSCLSQVWAQDI

SEQ ID NO: 9995 - protein, 11 aa, Canis lupus familiaris
FVKFKSWWCGT

SEQ ID NO: 9996 - protein, 24 aa, Canis lupus familiaris
FVLLSFRWPPLSLSRNWWWVSQRS

SEQ ID NO: 9997 - protein, 24 aa, Canis lupus familiaris
FVLVLECTSALLLPRTPTRVQWPQ

SEQ ID NO: 9998 - protein, 24 aa, Canis lupus familiaris
FVLVLECTSAPLLPRAPTRVQLPQ

SEQ ID NO: 9999 - protein, 20 aa, Canis lupus familiaris
FVMFFHYSNSPVLTLISMNC

SEQ ID NO: 10000 - protein, 14 aa, Canis lupus familiaris
FVMLLHRGLTQKMI

SEQ ID NO: 10001 - protein, 20 aa, Canis lupus familiaris
FVMSLPFSFSHAPTHCYLKG

SEQ ID NO: 10002 - protein, 20 aa, Canis lupus familiaris
FVNFFHYSNSPVLTLISMNC

SEQ ID NO: 10003 - protein, 21 aa, Canis lupus familiaris
FVNKKPKSLHPTRCSLHHYRG

SEQ ID NO: 10004 - skipped

SEQ ID NO: 10005 - protein, 54 aa, Canis lupus familiaris
FVNSYRVDISSLNFRHPLVSTVVKCLHAQIFIQPLVISVVHDSQRMISGTVPLF

SEQ ID NO: 10006 - protein, 22 aa, Canis lupus familiaris
FVPGRCCRCCSTYCQGPSGYFK

SEQ ID NO: 10007 - protein, 14 aa, Canis lupus familiaris
FVPLFAHCQQNTTL

SEQ ID NO: 10008 - protein, 44 aa, Canis lupus familiaris
FVRSHYIIHFKKSLSGRKTQSPLYLWISHHSYSFIFWAFHLCLP

SEQ ID NO: 10009 - protein, 10 aa, Canis lupus familiaris
FVSTKALRIC

SEQ ID NO: 10010 - protein, 19 aa, Canis lupus familiaris
FVTFFPSIDSLVLTLLSMN

SEQ ID NO: 10011 - protein, 10 aa, Canis lupus familiaris
FVVFCFVVLF

SEQ ID NO: 10012 - protein, 26 aa, Canis lupus familiaris
FVVLLGHLCSIVHTGRRMFLEHCDLE

SEQ ID NO: 10013 - protein, 35 aa, Canis lupus familiaris
FVVLLGHLCSIVHTGRRMFLEHCDLEYSMLQSPRS

SEQ ID NO: 10014 - protein, 22 aa, Canis lupus familiaris
FWDCTMFVRRQCSPGILNDSLL

SEQ ID NO: 10015 - protein, 81 aa, Canis lupus familiaris
FWESGGHVGQAPGGPELPEQRWGPPPEPHRGPELLGELREHGPCQGPQVPEQRQLDVRRRLGREEELGQLGCVGLGLRVQQ

SEQ ID NO: 10016 - protein, 9 aa, Canis lupus familiaris
FWFLKWSQW

SEQ ID NO: 10017 - protein, 9 aa, Canis lupus familiaris
FWGTCLCLT

SEQ ID NO: 10018 - protein, 13 aa, Canis lupus familiaris
FWIMKTMTFLSMT

SEQ ID NO: 10019 - protein, 34 aa, Canis lupus familiaris
FWIPVARCILKSSMRMETPATSISMSVLSKLFRG

SEQ ID NO: 10020 - protein, 9 aa, Canis lupus familiaris
FWKCWRPRS

SEQ ID NO: 10021 - protein, 16 aa, Canis lupus familiaris
FWKINLHTSFGRQGST

SEQ ID NO: 10022 - protein, 54 aa, Canis lupus familiaris
FWKITYGICTREFWSLKSKYLLCIIGIGRNIAKVQTIWTACIGISTLSLLKRIN

SEQ ID NO: 10023 - protein, 33 aa, Canis lupus familiaris
FWKWCMDGHILPKEMNCFQQKKIQIARNYCWIY

SEQ ID NO: 10024 - protein, 11 aa, Canis lupus familiaris
FWLEKMAVYMK

SEQ ID NO: 10025 - protein, 17 aa, Canis lupus familiaris
FWLMVLGPCLNLRVKLN

SEQ ID NO: 10026 - protein, 9 aa, Canis lupus familiaris
FWLNWSLPS

SEQ ID NO: 10027 - protein, 8 aa, Canis lupus familiaris
FWLSALAS

SEQ ID NO: 10028 - protein, 10 aa, Canis lupus familiaris
FWMATFQQKT

SEQ ID NO: 10029 - protein, 25 aa, Canis lupus familiaris
FWMLTCTMLCVRPYSVTVWCCRASR

SEQ ID NO: 10030 - protein, 18 aa, Canis lupus familiaris
FWMMSMIVPQLSFPVAIV

SEQ ID NO: 10031 - protein, 38 aa, Canis lupus familiaris
FWQRSQKTPNSSGIITSCGSVSRTSARSVRMPCGRTRP

SEQ ID NO: 10032 - protein, 9 aa, Canis lupus familiaris
FWQSLVWTQ

SEQ ID NO: 10033 - protein, 27 aa, Canis lupus familiaris
FWRRFFHGWEQLMTISNRRVQLKHLHV

SEQ ID NO: 10034 - protein, 8 aa, Canis lupus familiaris
FWSSCKRP

SEQ ID NO: 10035 - protein, 11 aa, Canis lupus familiaris
FWTCLKTNTGA

SEQ ID NO: 10036 - protein, 22 aa, Canis lupus familiaris
FWTHTTFRAAASTIAHANNSGY

SEQ ID NO: 10037 - protein, 13 aa, Canis lupus familiaris
FWTMKQVKSPFTM

SEQ ID NO: 10038 - protein, 10 aa, Canis lupus familiaris
FWTRKAARRP

SEQ ID NO: 10039 - protein, 13 aa, Canis lupus familiaris
FWTVILELYPFTT

SEQ ID NO: 10040 - protein, 10 aa, Canis lupus familiaris
FWWLSQPMWS

SEQ ID NO: 10041 - protein, 12 aa, Canis lupus familiaris
FWWWASMTSFLS

SEQ ID NO: 10042 - protein, 27 aa, Canis lupus familiaris
FYAVSPPFPLQDITRGNPRRTSWIPGC

SEQ ID NO: 10043 - protein, 8 aa, Canis lupus familiaris
FYDAPNHN

SEQ ID NO: 10044 - protein, 9 aa, Canis lupus familiaris
FYFWCTHQL

SEQ ID NO: 10045 - skipped

SEQ ID NO: 10046 - protein, 11 aa, Canis lupus familiaris
FYGLSMIFGLY

SEQ ID NO: 10047 - protein, 22 aa, Canis lupus familiaris
FYHDPFSSNKMWNLLSKELGSL

SEQ ID NO: 10048 - protein, 12 aa, Canis lupus familiaris
FYIMLIEYLSFH

SEQ ID NO: 10049 - skipped

SEQ ID NO: 10050 - protein, 18 aa, Canis lupus familiaris
FYINVPKAKLKRQKKFLV

SEQ ID NO: 10051 - protein, 12 aa, Canis lupus familiaris
FYIVRICLGTQH

SEQ ID NO: 10052 - protein, 12 aa, Canis lupus familiaris
FYIVRICLVIQN

SEQ ID NO: 10053 - protein, 46 aa, Canis lupus familiaris
FYIYYIFYLSFQRGKLLQRIGNALLPQLETPTGKLPISSLFNCKKN

SEQ ID NO: 10054 - protein, 21 aa, Canis lupus familiaris
FYKKTDQIFQWCFLNISHRLW

SEQ ID NO: 10055 - protein, 8 aa, Canis lupus familiaris
FYKTCMTF

SEQ ID NO: 10056 - protein, 9 aa, Canis lupus familiaris
FYLFVDPMK

SEQ ID NO: 10057 - protein, 13 aa, Canis lupus familiaris
FYLIGQAWILVKS

SEQ ID NO: 10058 - protein, 8 aa, Canis lupus familiaris
FYLPVVLE

SEQ ID NO: 10059 - protein, 35 aa, Canis lupus familiaris
FYMDLETQGTAGLTPSPPSGSLTSSTSVPMHPGSL

SEQ ID NO: 10060 - protein, 56 aa, Canis lupus familiaris
FYMDLLQEQVEYLTSQLLVHSISSVVPNGEIPRWWFKKICVGWGMLLDLTWRNFTE

SEQ ID NO: 10061 - protein, 11 aa, Canis lupus familiaris
FYPVYLDTAKK

SEQ ID NO: 10062 - protein, 9 aa, Canis lupus familiaris
FYRHYGTLL

SEQ ID NO: 10063 - protein, 28 aa, Canis lupus familiaris
FYSTKSLSGKCNIHHFICSTCEILGERL

SEQ ID NO: 10064 - protein, 17 aa, Canis lupus familiaris
FYTVLGYFLFLQMLPCL

SEQ ID NO: 10065 - protein, 26 aa, Canis lupus familiaris
FYWGTEVPPSFFWLYSTMNFRTPVFS

SEQ ID NO: 10066 - protein, 29 aa, Canis lupus familiaris
FYWIWLSVKDLYKIWMNRLKIIGKMTFGL

SEQ ID NO: 10067 - protein, 14 aa, Canis lupus familiaris
FYYYVQRFFYTKKL

SEQ ID NO: 10068 - protein, 22 aa, Canis lupus familiaris
LAAKTSSLIPHLKDLLVQSCVR

SEQ ID NO: 10069 - protein, 25 aa, Canis lupus familiaris
LAALIRHLMYLGESKLTLSSLNQKV

SEQ ID NO: 10070 - protein, 8 aa, Canis lupus familiaris
LAFLNAMC

SEQ ID NO: 10071 - protein, 10 aa, Canis lupus familiaris
LAGRATGRAL

SEQ ID NO: 10072 - protein, 14 aa, Canis lupus familiaris
LAGTRGGKRKKHET

SEQ ID NO: 10073 - protein, 15 aa, Canis lupus familiaris
LAKLHCLRPEMSQKH

SEQ ID NO: 10074 - skipped

SEQ ID NO: 10075 - protein, 9 aa, Canis lupus familiaris
LAQDNQIGF

SEQ ID NO: 10076 - protein, 8 aa, Canis lupus familiaris
LARIRCGN

SEQ ID NO: 10077 - protein, 15 aa, Canis lupus familiaris
LASVETSGYPYYSIG

SEQ ID NO: 10078 - protein, 10 aa, Canis lupus familiaris
LASYYRNLDL

SEQ ID NO: 10079 - protein, 19 aa, Canis lupus familiaris
LAVSAVTGKARSLGLKKVS

SEQ ID NO: 10080 - protein, 24 aa, Canis lupus familiaris
LAVVLQGARQLRPRVGKWRASWSP

SEQ ID NO: 10081 - protein, 8 aa, Canis lupus familiaris
LAWITWKN

SEQ ID NO: 10082 - protein, 13 aa, Canis lupus familiaris
LCFLDVWIVSSWL

SEQ ID NO: 10083 - protein, 19 aa, Canis lupus familiaris
LCGQTTPGAQTVSNHGRGK

SEQ ID NO: 10084 - protein, 33 aa, Canis lupus familiaris
LCHGNHVSKEPTLLLPEERLEPVTEHRNQTTLQ

SEQ ID NO: 10085 - protein, 23 aa, Canis lupus familiaris
LCILQMCLEDPAGKQWWDRNLCG

SEQ ID NO: 10086 - protein, 34 aa, Canis lupus familiaris
LCLDRAGHLAVQREPASSSTCRAPSSPLGTSASR

SEQ ID NO: 10087 - protein, 62 aa, Canis lupus familiaris
LCLYTSRFTGDYTPNCSLDYSPKNFKEDKLQSSSGGKDFKFFRYMDFIQKVLGVPLGVLQSS

SEQ ID NO: 10088 - protein, 43 aa, Canis lupus familiaris
LCPLIHLSDLSVFFKYLKSVDGEHVCILYYVFSFSQPLCAHEL

SEQ ID NO: 10089 - protein, 58 aa, Canis lupus familiaris
LCSFLPTLYSTDVLKLINISFIPGSISLAITGGQLIRFDPSLSPMLTPTVFLLVLTFP

SEQ ID NO: 10090 - protein, 10 aa, Canis lupus familiaris
LCSSRTRCRY

SEQ ID NO: 10091 - protein, 59 aa, Canis lupus familiaris
LCTYYSPLRDVWDIVQKLFLMQNYTHVTLMKLKLEVTVFVSCLLHCHHHPQEGRKLWWS

SEQ ID NO: 10092 - protein, 66 aa, Canis lupus familiaris
LDDFKFLALIYSFLLHHGVLYSGLESCVEGPFCSWTKKSFLYLWVPSGCGFTVLWLSDGHVSEPDI

SEQ ID NO: 10093 - protein, 31 aa, Canis lupus familiaris
LDFIGYSSSGEGASTNYCTGNLLSLLFFTRP

SEQ ID NO: 10094 - protein, 19 aa, Canis lupus familiaris
LDLSSITLHIEFSKTCILS

SEQ ID NO: 10095 - protein, 23 aa, Canis lupus familiaris
LDLWQLLQFLRDVLPASLIHMKS

SEQ ID NO: 10096 - protein, 21 aa, Canis lupus familiaris
LDQDSLSICTPALAILWARTR

SEQ ID NO: 10097 - protein, 31 aa, Canis lupus familiaris
LDQVSQRKYQNWSSILTKLTVSSFPTLATDL

SEQ ID NO: 10098 - protein, 21 aa, Canis lupus familiaris
LDSSKWLEKHHPPQSLFPGQL

SEQ ID NO: 10099 - protein, 12 aa, Canis lupus familiaris
LDTDSGKQNYFS

SEQ ID NO: 10100 - protein, 55 aa, Canis lupus familiaris
LEAGHRTMHGELTGDLRYHSQAREVQSPQYAAIFVNQWCSFHLGYRYNHGHVQHR

SEQ ID NO: 10101 - skipped

SEQ ID NO: 10102 - protein, 11 aa, Canis lupus familiaris
LELVPLPTTMQ

SEQ ID NO: 10103 - protein, 10 aa, Canis lupus familiaris
LEMTLYPMTF

SEQ ID NO: 10104 - skipped

SEQ ID NO: 10105 - protein, 23 aa, Canis lupus familiaris
LETELGSGIWHRYFLPHDALLQL

SEQ ID NO: 10106 - protein, 22 aa, Canis lupus familiaris
LEVFAWRKLYRGYVSHSGVSWT

SEQ ID NO: 10107 - protein, 10 aa, Canis lupus familiaris
LEVLKASCLL

SEQ ID NO: 10108 - protein, 10 aa, Canis lupus familiaris
LEVLMSSCLL

SEQ ID NO: 10109 - protein, 15 aa, Canis lupus familiaris
LFFFFFFVLKILHVP

SEQ ID NO: 10110 - protein, 30 aa, Canis lupus familiaris
LFFTMWWKRYWKFVFTSYTISGVSGIVWML

SEQ ID NO: 10111 - protein, 76 aa, Canis lupus familiaris
LFIIPPWANSLWNFMCMSVRYPLGNQTAATEKERVSINQQKWEEANGGCIFSSILQCRWRRRKSFVVCLKGPAEKV

SEQ ID NO: 10112 - protein, 77 aa, Canis lupus familiaris
LFIIPPWANSLWNFMCMSVRYPLGNQTAATEKERVSINQQKWEEANGGCIFSSILQCRWRRRKSFVVCLKGPAEKVP

SEQ ID NO: 10113 - protein, 11 aa, Canis lupus familiaris
LFKWNSGKILI

SEQ ID NO: 10114 - protein, 11 aa, Canis lupus familiaris
LFLLPHSSSPT

SEQ ID NO: 10115 - protein, 9 aa, Canis lupus familiaris
LFPPSPTHS

SEQ ID NO: 10116 - protein, 30 aa, Canis lupus familiaris
LFPRSPPKKSTQSPAMPAIKWGRTLHSCSG

SEQ ID NO: 10117 - protein, 10 aa, Canis lupus familiaris
LFSQKELREH

SEQ ID NO: 10118 - protein, 42 aa, Canis lupus familiaris
LFTSVRLKIGVLIYLGEQKIPTKKLIIIHWRKFVRILIFSTA

SEQ ID NO: 10119 - protein, 59 aa, Canis lupus familiaris
LFWSWSVPQLCCSPELPHECSGLSDVHSGHTHAEPLHLQPEEQRHKEGSEKSHWGSSDV

SEQ ID NO: 10120 - protein, 59 aa, Canis lupus familiaris
LFWSWSVPQLRCSPELPLECSCLSDVYSGHTHAKPLHLQPEEQRHKESSEKILWGSSDV

SEQ ID NO: 10121 - protein, 15 aa, Canis lupus familiaris
LGLRTCAVSLVDMAL

SEQ ID NO: 10122 - protein, 8 aa, Canis lupus familiaris
LGQAATLV

SEQ ID NO: 10123 - protein, 32 aa, Canis lupus familiaris
LGRWDWSISSGRELEDRWKRTLYMGSFHPHTP

SEQ ID NO: 10124 - protein, 20 aa, Canis lupus familiaris
LGSLQMWSVSCWLSWLMTGM

SEQ ID NO: 10125 - skipped

SEQ ID NO: 10126 - protein, 8 aa, Canis lupus familiaris
LGSPKKKP

SEQ ID NO: 10127 - protein, 8 aa, Canis lupus familiaris
LGTRLSQS

SEQ ID NO: 10128 - skipped

SEQ ID NO: 10129 - protein, 22 aa, Canis lupus familiaris
LHHIWTSRNPRLGQREDPYPPL

SEQ ID NO: 10130 - protein, 11 aa, Canis lupus familiaris
LHHSLCIRYNL

SEQ ID NO: 10131 - protein, 29 aa, Canis lupus familiaris
LHLLCHMSLAILWVCGMMKKRVNVQTMCA

SEQ ID NO: 10132 - protein, 20 aa, Canis lupus familiaris
LHLSWQHWWCLQFWALKQML

SEQ ID NO: 10133 - protein, 12 aa, Canis lupus familiaris
LHLYCCNQTLEI

SEQ ID NO: 10134 - protein, 60 aa, Canis lupus familiaris
LHLYLQDLDFIFINKGLHPKHSIQDVQFMKITMAKQLLRTPCMTPTQSQWKERQYDLIPT

SEQ ID NO: 10135 - protein, 16 aa, Canis lupus familiaris
LHPFTYSILHSEKISG

SEQ ID NO: 10136 - protein, 19 aa, Canis lupus familiaris
LHQNFFNLQILFCKYFGKH

SEQ ID NO: 10137 - protein, 22 aa, Canis lupus familiaris
LHRTSIQPHGLRMTSSDKLLVS

SEQ ID NO: 10138 - protein, 14 aa, Canis lupus familiaris
LHYKSSTFKNSTSD

SEQ ID NO: 10139 - protein, 13 aa, Canis lupus familiaris
LIASGLNLLSTQV

SEQ ID NO: 10140 - protein, 11 aa, Canis lupus familiaris
LIFLDVWTVYS

SEQ ID NO: 10141 - protein, 15 aa, Canis lupus familiaris
LIFNQVGITSLIQMK

SEQ ID NO: 10142 - protein, 9 aa, Canis lupus familiaris
LIKKVKKLF

SEQ ID NO: 10143 - skipped

SEQ ID NO: 10144 - protein, 28 aa, Canis lupus familiaris
LITRLQPWPGRRGKACIKTWLSFGTRRK

SEQ ID NO: 10145 - protein, 41 aa, Canis lupus familiaris
LKALTGNISERDLLQYLLKSKALMIPQTSMNFQNLIFLSQQ

SEQ ID NO: 10146 - protein, 68 aa, Canis lupus familiaris
LKALTGNISERDLLQYLLKSKALMIPQTSMNFQNLIFLSQQLQVITLRLTTRTKTGSSSITHTSALRA

SEQ ID NO: 10147 - protein, 9 aa, Canis lupus familiaris
LKCSEMKMS

SEQ ID NO: 10148 - protein, 14 aa, Canis lupus familiaris
LKDWRQKPRKCSRK

SEQ ID NO: 10149 - protein, 28 aa, Canis lupus familiaris
LKEINTGDTTVTRIRPTQKMNKETSTPN

SEQ ID NO: 10150 - protein, 24 aa, Canis lupus familiaris
LKERMETSFQLPKRPRNLNGPYRL

SEQ ID NO: 10151 - protein, 14 aa, Canis lupus familiaris
LKGLMISTGRKMGR

SEQ ID NO: 10152 - skipped

SEQ ID NO: 10153 - protein, 9 aa, Canis lupus familiaris
LKKAHIFNV

SEQ ID NO: 10154-10155 - skipped (2 entries)

SEQ ID NO: 10156 - protein, 8 aa, Canis lupus familiaris
LKKTVTLK

SEQ ID NO: 10157 - protein, 54 aa, Canis lupus familiaris
LKLSENFSCLSTNFLCLDHILFPLKSIFHTSCKTSLFLHHKDQESLYSFQSMMH

SEQ ID NO: 10158 - protein, 8 aa, Canis lupus familiaris
LKMRLSRN

SEQ ID NO: 10159 - protein, 8 aa, Canis lupus familiaris
LKNIPRIF

SEQ ID NO: 10160 - protein, 8 aa, Canis lupus familiaris
LKNQTMTT

SEQ ID NO: 10161 - protein, 18 aa, Canis lupus familiaris
LKPSRIMMNREVQDEPLA

SEQ ID NO: 10162 - protein, 12 aa, Canis lupus familiaris
LKQRKATQSIHS

SEQ ID NO: 10163 - protein, 19 aa, Canis lupus familiaris
LKRKTSVPSRTAGAASSAA

SEQ ID NO: 10164 - protein, 26 aa, Canis lupus familiaris
LKSWILWKIVFILLMDPMGKQLVKAL

SEQ ID NO: 10165 - protein, 42 aa, Canis lupus familiaris
LKTLILMKMKENCLEVKNLSQVKVPETSNTKTSLIQLKVMKT

SEQ ID NO: 10166 - protein, 13 aa, Canis lupus familiaris
LKTLKERLNYHHH

SEQ ID NO: 10167 - protein, 10 aa, Canis lupus familiaris
LKVMRLKICF

SEQ ID NO: 10168 - protein, 48 aa, Canis lupus familiaris
LKYLLMLLCMFVNRGMSKDSTKKHGLEKLKASLVSILSMKNQKLLNWC

SEQ ID NO: 10169 - protein, 9 aa, Canis lupus familiaris
LLARMIRTL

SEQ ID NO: 10170 - protein, 12 aa, Canis lupus familiaris
LLCYLKQTQRKA

SEQ ID NO: 10171 - skipped

SEQ ID NO: 10172 - protein, 64 aa, Canis lupus familiaris
LLEEKRGWQRSSSHRPSTTITSWHRRPDGRRELGRRLSGGRRPRGQPGWPKRPNQRPLGPRSRS

SEQ ID NO: 10173 - protein, 27 aa, Canis lupus familiaris
LLFCWDIYVLLCTLADVCFWNIAIWNN

SEQ ID NO: 10174 - protein, 34 aa, Canis lupus familiaris
LLFFVLLFCFRIGGFHLMLKKALLFPNYILPKRI

SEQ ID NO: 10175 - protein, 8 aa, Canis lupus familiaris
LLFLNAMC

SEQ ID NO: 10176 - protein, 8 aa, Canis lupus familiaris
LLFTWQVF

SEQ ID NO: 10177 - protein, 31 aa, Canis lupus familiaris
LLGSGAPSLMQAEHSASAVSAPLGASVQFRR

SEQ ID NO: 10178 - protein, 24 aa, Canis lupus familiaris
LLICFRKFLLKKRKENKNLLKIRA

SEQ ID NO: 10179 - protein, 37 aa, Canis lupus familiaris
LLIQCRDWKTQKTHWSTPGLVRESVLTAQSQFQVLKQ

SEQ ID NO: 10180 - protein, 29 aa, Canis lupus familiaris
LLIVLDIPAVKQDLKMGTSSCLTEVCSRM

SEQ ID NO: 10181 - protein, 29 aa, Canis lupus familiaris
LLIVLDIPAVKQDLKMGTSSCLTEVCSRV

SEQ ID NO: 10182 - protein, 29 aa, Canis lupus familiaris
LLKNLIYSVRSTERYLSIMNCLRKDLHIT

SEQ ID NO: 10183 - protein, 18 aa, Canis lupus familiaris
LLLLGAPLHQVAEGGGAV

SEQ ID NO: 10184 - protein, 36 aa, Canis lupus familiaris
LLLMKPRITASLMPLEPLHQETLIFPNSLFSLKVRD

SEQ ID NO: 10185 - protein, 25 aa, Canis lupus familiaris
LLLRTNIFFHLLAQKYVNLKIKLEF

SEQ ID NO: 10186 - protein, 8 aa, Canis lupus familiaris
LLLVMTKL

SEQ ID NO: 10187 - protein, 17 aa, Canis lupus familiaris
LLMLLKHTKVDLLTLNN

SEQ ID NO: 10188 - protein, 18 aa, Canis lupus familiaris
LLMNSWLGSLRTQITKQW

SEQ ID NO: 10189 - protein, 18 aa, Canis lupus familiaris
LLMNSWLGSLRTQVTKKW

SEQ ID NO: 10190 - protein, 33 aa, Canis lupus familiaris
LLNPLSKEHQHTMTEELDAETFFWLSMVEVHQE

SEQ ID NO: 10191 - protein, 14 aa, Canis lupus familiaris
LLPIRHDLCFGELL

SEQ ID NO: 10192 - protein, 72 aa, Canis lupus familiaris
LLPPAAPCGCHFTWKLDKHSLIFEILDTFLRLLVLPDSAPKVPAWLHLHGSSAQVPGGLATGDCPGESWLPG

SEQ ID NO: 10193 - protein, 19 aa, Canis lupus familiaris
LLPSVRLSSFLLDLILQLH

SEQ ID NO: 10194 - protein, 23 aa, Canis lupus familiaris
LLQFSDCILHNNQIGQLSPTPHV

SEQ ID NO: 10195 - protein, 10 aa, Canis lupus familiaris
LLRISTMMQL

SEQ ID NO: 10196 - protein, 19 aa, Canis lupus familiaris
LLRQSPVWLLKMLVLCPLK

SEQ ID NO: 10197 - protein, 25 aa, Canis lupus familiaris
LLTAQESRWLYPEALSRPRDFFCHA

SEQ ID NO: 10198 - protein, 22 aa, Canis lupus familiaris
LLTIQVLVSLKSASTLAFEEKK

SEQ ID NO: 10199 - protein, 31 aa, Canis lupus familiaris
LLTLTEMIITGVATLHPDPFTNEWIGYWNPI

SEQ ID NO: 10200 - protein, 12 aa, Canis lupus familiaris
LLTRIPVQFQQL

SEQ ID NO: 10201 - protein, 12 aa, Canis lupus familiaris
LLVFTPQHFWKM

SEQ ID NO: 10202 - protein, 9 aa, Canis lupus familiaris
LLWLAVFGG

SEQ ID NO: 10203 - skipped

SEQ ID NO: 10204 - protein, 30 aa, Canis lupus familiaris
LLYFLGQQNFTSWLLCPMTAMLPYANPCIT

SEQ ID NO: 10205 - protein, 30 aa, Canis lupus familiaris
LLYFLGQQSFISWLLCPMTAMLPYANPCII

SEQ ID NO: 10206 - skipped

SEQ ID NO: 10207 - protein, 22 aa, Canis lupus familiaris
LMFAHFQMRLNSKNAHLPIISF

SEQ ID NO: 10208 - protein, 16 aa, Canis lupus familiaris
LMHLCLELSRFSTGGA

SEQ ID NO: 10209 - protein, 10 aa, Canis lupus familiaris
LMLDIPNYNQ

SEQ ID NO: 10210 - protein, 59 aa, Canis lupus familiaris
LMLWILYYIRFTIHLKIQLPALLLFQSGPNRSLAALIPGMQLLWRSGFLPPTLVVPVQV

SEQ ID NO: 10211 - protein, 9 aa, Canis lupus familiaris
LMMIITGRC

SEQ ID NO: 10212 - protein, 64 aa, Canis lupus familiaris
LMMKTELFQVLQLLWFHIVLMDLLKQFIPHKLLVFLDSGLGHLKICHKQVQVTLILANLLLKEA

SEQ ID NO: 10213 - protein, 20 aa, Canis lupus familiaris
LMMSGPGGQWHLMSMRLSHG

SEQ ID NO: 10214 - protein, 16 aa, Canis lupus familiaris
LMNFKEQIVKLNLPKP

SEQ ID NO: 10215 - protein, 26 aa, Canis lupus familiaris
LMNSPSWSSQESQEITQFVRKNSAVI

SEQ ID NO: 10216 - protein, 55 aa, Canis lupus familiaris
LMRSSFQPPHSGSSDGALRSRMEERCPTPCYRHLSSSLTTLGAMQRTHTRGKSPK

SEQ ID NO: 10217 - protein, 8 aa, Canis lupus familiaris
LMVKGKYA

SEQ ID NO: 10218 - protein, 21 aa, Canis lupus familiaris
LNAMLMVQYLMNIVGHFQNQQ

SEQ ID NO: 10219 - protein, 15 aa, Canis lupus familiaris
LNEPFCATVLCGVVL

SEQ ID NO: 10220 - protein, 51 aa, Canis lupus familiaris
LNHSAGLILYKRGFHHHLILMWQDQMISGTLMQRLQKKQFRILCVYLLTIL

SEQ ID NO: 10221 - protein, 14 aa, Canis lupus familiaris
LNKNLLKWNVKIVL

SEQ ID NO: 10222 - protein, 29 aa, Canis lupus familiaris
LNMIMYSLPLTYSNLHTLTILKKYMLSQN

SEQ ID NO: 10223 - protein, 18 aa, Canis lupus familiaris
LNPEFVSFFQASACWITR

SEQ ID NO: 10224 - protein, 8 aa, Canis lupus familiaris
LNSMRKLK

SEQ ID NO: 10225 - protein, 18 aa, Canis lupus familiaris
LNTSGNTEWLWTEEITDS

SEQ ID NO: 10226 - protein, 8 aa, Canis lupus familiaris
LPARKFSL

SEQ ID NO: 10227 - protein, 18 aa, Canis lupus familiaris
LPATLTVRWCCKASTSSE

SEQ ID NO: 10228 - protein, 18 aa, Canis lupus familiaris
LPAVSRLFIFLCMRFITS

SEQ ID NO: 10229 - protein, 10 aa, Canis lupus familiaris
LPCGNLIEAP

SEQ ID NO: 10230 - protein, 32 aa, Canis lupus familiaris
LPGFLGKPNGAQKAIWTSVWVLSWSPDVYCYL

SEQ ID NO: 10231 - skipped

SEQ ID NO: 10232 - protein, 8 aa, Canis lupus familiaris
LPLMFLLR

SEQ ID NO: 10233 - protein, 25 aa, Canis lupus familiaris
LPPHLSACKTAGRVQPRSFGRPGCF

SEQ ID NO: 10234 - protein, 18 aa, Canis lupus familiaris
LPPYLLFIDFSLLRYSRS

SEQ ID NO: 10235 - protein, 12 aa, Canis lupus familiaris
LPSFWGQLNFIF

SEQ ID NO: 10236 - protein, 8 aa, Canis lupus familiaris
LPSIPKQV

SEQ ID NO: 10237 - protein, 27 aa, Canis lupus familiaris
LPSKKTDFLSLSRYVIRLRNLAGDYHL

SEQ ID NO: 10238 - protein, 13 aa, Canis lupus familiaris
LPSQLPSKCPSSQ

SEQ ID NO: 10239 - protein, 26 aa, Canis lupus familiaris
LPSSLCVSYGQWMEEKKRTNGTGWLF

SEQ ID NO: 10240 - protein, 14 aa, Canis lupus familiaris
LPTANLSQGLPAAV

SEQ ID NO: 10241 - protein, 17 aa, Canis lupus familiaris
LPTSLAMKATGVLILWL

SEQ ID NO: 10242 - protein, 78 aa, Canis lupus familiaris
LPVKLLVHMVLLYQNSYKHHGNCSYYNCSFLLSFGRFKVYEQCQVLLPGGTCLHNSSHSSHSMDTFGLQTFLARTKKA

SEQ ID NO: 10243 - protein, 19 aa, Canis lupus familiaris
LQALIQFRELGVKTYFRPS

SEQ ID NO: 10244 - protein, 27 aa, Canis lupus familiaris
LQCLSGVERPRSHMSVGPLSCPCAGEW

SEQ ID NO: 10245 - protein, 21 aa, Canis lupus familiaris
LQCPFLGIRSSIQHGKRRQFG

SEQ ID NO: 10246 - protein, 13 aa, Canis lupus familiaris
LQECRRERETRKS

SEQ ID NO: 10247 - skipped

SEQ ID NO: 10248 - protein, 22 aa, Canis lupus familiaris
LQHWMSSNLSWRRNITELLPST

SEQ ID NO: 10249 - protein, 71 aa, Canis lupus familiaris
LQKFHLKKPIADLLPVQEPMKRASKEVVCKKKTKLKMCPLNLKYNLKTNKNSSFLMMMKKLERIIPSSWAL

SEQ ID NO: 10250 - protein, 14 aa, Canis lupus familiaris
LQKGKSTICSARLG

SEQ ID NO: 10251 - protein, 13 aa, Canis lupus familiaris
LQKHSSTGHTLFE

SEQ ID NO: 10252 - protein, 8 aa, Canis lupus familiaris
LQKIFIRT

SEQ ID NO: 10253 - protein, 18 aa, Canis lupus familiaris
LQKSTCRSTPKTRRRLSC

SEQ ID NO: 10254 - protein, 13 aa, Canis lupus familiaris
LQLLLLQMECVIC

SEQ ID NO: 10255 - protein, 16 aa, Canis lupus familiaris
LQMLKVTLLLAQQIRL

SEQ ID NO: 10256 - protein, 12 aa, Canis lupus familiaris
LQPKKSMIECRI

SEQ ID NO: 10257 - protein, 11 aa, Canis lupus familiaris
LQQKIMKHQNF

SEQ ID NO: 10258 - protein, 19 aa, Canis lupus familiaris
LQRNRDFSFWLEIKDTRRT

SEQ ID NO: 10259 - protein, 43 aa, Canis lupus familiaris
LQRYGCAHSGLPVKALPPRPPRASGSLEPVRGVPAMWAAHECG

SEQ ID NO: 10260 - protein, 9 aa, Canis lupus familiaris
LQSCKIVSF

SEQ ID NO: 10261 - protein, 10 aa, Canis lupus familiaris
LQSKEMAQDH

SEQ ID NO: 10262 - protein, 11 aa, Canis lupus familiaris
LQVRTVEIMRR

SEQ ID NO: 10263 - protein, 30 aa, Canis lupus familiaris
LQWASNKAGRDLGNCNWKERKRCFLQLWSG

SEQ ID NO: 10264 - protein, 18 aa, Canis lupus familiaris
LQYLKSAYTSSSTWGSDI

SEQ ID NO: 10265 - protein, 8 aa, Canis lupus familiaris
LQYVKVTL

SEQ ID NO: 10266 - protein, 13 aa, Canis lupus familiaris
LRCCLLVSSRSIC

SEQ ID NO: 10267 - protein, 15 aa, Canis lupus familiaris
LRCLLGSILMDTGTK

SEQ ID NO: 10268 - protein, 13 aa, Canis lupus familiaris
LRCLLSSSRSNRA

SEQ ID NO: 10269 - protein, 61 aa, Canis lupus familiaris
LREKQYLITGCQEYVIVILLFSWYLKQLLIKVLLWSTVASVMNPNSIELPLIHLEISRFVL

SEQ ID NO: 10270 - protein, 33 aa, Canis lupus familiaris
LRGAGVTVESLFMSSTPKQRQSSILTGLTPIDP

SEQ ID NO: 10271 - protein, 13 aa, Canis lupus familiaris
LRGKGRRLPSATS

SEQ ID NO: 10272 - protein, 11 aa, Canis lupus familiaris
LRIFSPGRRSP

SEQ ID NO: 10273 - protein, 24 aa, Canis lupus familiaris
LRKAHNAPVPFLMFLDLSPCCQMP

SEQ ID NO: 10274 - protein, 8 aa, Canis lupus familiaris
LRKISVNM

SEQ ID NO: 10275 - protein, 14 aa, Canis lupus familiaris
LRKKIALDRRFYLM

SEQ ID NO: 10276 - protein, 33 aa, Canis lupus familiaris
LRLFLPRWKSGMKGRLKKLEAKPVRKPSKTRPP

SEQ ID NO: 10277 - protein, 13 aa, Canis lupus familiaris
LRLLLLQMECVIC

SEQ ID NO: 10278 - protein, 11 aa, Canis lupus familiaris
LRLPFHHFVTL

SEQ ID NO: 10279 - protein, 18 aa, Canis lupus familiaris
LRPLRPSDSALMMPFMVS

SEQ ID NO: 10280 - protein, 10 aa, Canis lupus familiaris
LRRIGHSSFS

SEQ ID NO: 10281 - protein, 12 aa, Canis lupus familiaris
LRSPRHSPQAMV

SEQ ID NO: 10282 - protein, 25 aa, Canis lupus familiaris
LRTTSAASRLSWMGSIWRRTSCRER

SEQ ID NO: 10283 - protein, 13 aa, Canis lupus familiaris
LSARYKKTQNTCV

SEQ ID NO: 10284 - protein, 11 aa, Canis lupus familiaris
LSKHITSHTVN

SEQ ID NO: 10285 - protein, 22 aa, Canis lupus familiaris
LSMTLRLLQISHHLQYMMNFYC

SEQ ID NO: 10286 - skipped

SEQ ID NO: 10287 - protein, 11 aa, Canis lupus familiaris
LSPPQRLGCPA

SEQ ID NO: 10288 - protein, 68 aa, Canis lupus familiaris
LSRKSKYKVVEMIQSGVHILQLQLRIPAVHPARTGWSIVLFVRMKCWSLRLMSTWTGALKVVASKSKV

SEQ ID NO: 10289 - protein, 16 aa, Canis lupus familiaris
LSRLTENVLKSLLRHQ

SEQ ID NO: 10290 - protein, 9 aa, Canis lupus familiaris
LSSRVLSQP

SEQ ID NO: 10291 - protein, 50 aa, Canis lupus familiaris
LSSVFLWKECHRPELQIQADLSQRFILAICVSQWRKTSCTWLNTKELTLA

SEQ ID NO: 10292 - protein, 46 aa, Canis lupus familiaris
LSSWGPLNVSFSPQWPMIAMLLSVILCITQWLCPQDSAVPSSLGPI

SEQ ID NO: 10293 - protein, 22 aa, Canis lupus familiaris
LSSYILSGLLVNSLQYMLPYHM

SEQ ID NO: 10294 - protein, 8 aa, Canis lupus familiaris
LSTATEWT

SEQ ID NO: 10295 - protein, 31 aa, Canis lupus familiaris
LSTSTSRCSPARLLRVTRLAAVGSYTPPAST

SEQ ID NO: 10296 - protein, 22 aa, Canis lupus familiaris
LSVLLRRQSSAIFSSGQKTDQE

SEQ ID NO: 10297 - protein, 8 aa, Canis lupus familiaris
LTCGDLDE

SEQ ID NO: 10298 - protein, 22 aa, Canis lupus familiaris
LTMHHLLNLPALFVVKWCQGMT

SEQ ID NO: 10299 - protein, 14 aa, Canis lupus familiaris
LTNREMDVVLTVMY

SEQ ID NO: 10300 - protein, 14 aa, Canis lupus familiaris
LTPSRRTVVKMRKG

SEQ ID NO: 10301 - protein, 9 aa, Canis lupus familiaris
LTQHPQVGL

SEQ ID NO: 10302 - protein, 19 aa, Canis lupus familiaris
LTSFIIQKQDPCFLLFLPI

SEQ ID NO: 10303 - protein, 17 aa, Canis lupus familiaris
LTSLLTAPFAMLMGSLM

SEQ ID NO: 10304 - protein, 9 aa, Canis lupus familiaris
LTSSWGKPT

SEQ ID NO: 10305 - protein, 8 aa, Canis lupus familiaris
LTTPYHRL

SEQ ID NO: 10306 - protein, 14 aa, Canis lupus familiaris
LTVQEEGDPMFISI

SEQ ID NO: 10307 - protein, 28 aa, Canis lupus familiaris
LVEGDGGRPTKPALTEASGIIGRPSQQI

SEQ ID NO: 10308 - protein, 43 aa, Canis lupus familiaris
LVEIYLLTAPPIEVCQTGILLHVTFFQEVQVPFLLSRMTWSMD

SEQ ID NO: 10309 - protein, 18 aa, Canis lupus familiaris
LVESISIFSHPSSDWWEM

SEQ ID NO: 10310 - protein, 8 aa, Canis lupus familiaris
LVFLKLMC

SEQ ID NO: 10311 - protein, 10 aa, Canis lupus familiaris
LVLLRLSSLQ

SEQ ID NO: 10312 - protein, 16 aa, Canis lupus familiaris
LVLVNILEHPGLWAKY

SEQ ID NO: 10313 - protein, 29 aa, Canis lupus familiaris
LVPLRSSSWWPWPMTDMQPSADPFTIWSS

SEQ ID NO: 10314 - protein, 30 aa, Canis lupus familiaris
LVSAVFLLAVPLLKKLLKWHLVEIAPKWIN

SEQ ID NO: 10315 - protein, 10 aa, Canis lupus familiaris
LVSSFSMHYV

SEQ ID NO: 10316 - protein, 59 aa, Canis lupus familiaris
LVVGRCWELLSQPLMPAMVASSQWRPTCYSGAWSRAAFPSCAPSGRRPHAVRCSSTRWR

SEQ ID NO: 10317 - protein, 13 aa, Canis lupus familiaris
LVVLLRSVFLVSL

SEQ ID NO: 10318 - protein, 13 aa, Canis lupus familiaris
LVVNFISQKTWQI

SEQ ID NO: 10319 - protein, 14 aa, Canis lupus familiaris
LVYLMDIMVPQQQT

SEQ ID NO: 10320 - protein, 13 aa, Canis lupus familiaris
LWFLEAWTLSSLL

SEQ ID NO: 10321 - protein, 26 aa, Canis lupus familiaris
LWGALAGWPSLWTALAGRLSAVQMAP

SEQ ID NO: 10322 - skipped

SEQ ID NO: 10323 - protein, 29 aa, Canis lupus familiaris
LWILMQNSLNLPIRKERVSGISLKKMYLL

SEQ ID NO: 10324 - protein, 13 aa, Canis lupus familiaris
LWLKKTILHYQSQ

SEQ ID NO: 10325 - skipped

SEQ ID NO: 10326 - protein, 14 aa, Canis lupus familiaris
LWRWNTKNSLLWNL

SEQ ID NO: 10327 - protein, 11 aa, Canis lupus familiaris
LWSPSVWILRS

SEQ ID NO: 10328 - protein, 16 aa, Canis lupus familiaris
LWTPHLIVDSRQIKTL

SEQ ID NO: 10329 - protein, 22 aa, Canis lupus familiaris
LYDDRLLADSDRLYAVQTNFWL

SEQ ID NO: 10330 - protein, 18 aa, Canis lupus familiaris
LYHYYLFDMCFILCQDFQ

SEQ ID NO: 10331 - protein, 8 aa, Canis lupus familiaris
LYKFRSVP

SEQ ID NO: 10332 - protein, 8 aa, Canis lupus familiaris
LYKPRSIP

SEQ ID NO: 10333 - protein, 8 aa, Canis lupus familiaris
LYMPGCSH

SEQ ID NO: 10334 - protein, 8 aa, Canis lupus familiaris
LYNNFDTS

SEQ ID NO: 10335 - protein, 34 aa, Canis lupus familiaris
LYPGILSRSAHHGHAPPRGVRAAVCLGLGNPHLL

SEQ ID NO: 10336 - protein, 13 aa, Canis lupus familiaris
LYSLLSQTSLSSV

SEQ ID NO: 10337 - protein, 26 aa, Canis lupus familiaris
LYSPTRPTENKFPTRYKYPEKQAIRR

SEQ ID NO: 10338 - protein, 35 aa, Canis lupus familiaris
LYVYFISVFSDSLYICIRYHPRHSSFTTDRIPQCS

SEQ ID NO: 10339 - protein, 12 aa, Canis lupus familiaris
SASDSLCKRTGA

SEQ ID NO: 10340 - protein, 90 aa, Canis lupus familiaris
SAVLFYRAIQDGQELLRVQGEEGSAYPVHLLQPLAVQLMHRGAPAWPRPWGPTLSAGPQGTTRSEQWFWGLRLVLSSTHTGSAQAILRDL

SEQ ID NO: 10341 - protein, 21 aa, Canis lupus familiaris
SCSCTREKEIWSSWLEYSIRI

SEQ ID NO: 10342 - protein, 10 aa, Canis lupus familiaris
SCYLLRRRVL

SEQ ID NO: 10343 - protein, 38 aa, Canis lupus familiaris
SDGHPRFRGKPALDSIATVCPLCPCCNGQCHHHLHHLD

SEQ ID NO: 10344 - protein, 38 aa, Canis lupus familiaris
SDGHPRFRGKPALDSIATVCPLCPCCNGQCHRHLHHLD

SEQ ID NO: 10345 - protein, 9 aa, Canis lupus familiaris
SDLYQEKRY

SEQ ID NO: 10346 - protein, 37 aa, Canis lupus familiaris
SDTVFGCSRRRLWVSLPWSNNSSGETDSKHSHYDGHL

SEQ ID NO: 10347 - protein, 56 aa, Canis lupus familiaris
SEPLCAGLLYTSLDSGNAGLPVGAFGRARTSQLHGPTFCCDCDVCLVYSSLYSFSC

SEQ ID NO: 10348 - protein, 25 aa, Canis lupus familiaris
SFAIEPQCDSGTRLPFSAEGQKALE

SEQ ID NO: 10349 - protein, 17 aa, Canis lupus familiaris
SGFAGQPRWESSPNSRQ

SEQ ID NO: 10350 - protein, 22 aa, Canis lupus familiaris
SGRGRQREDLDRRPASPGPGAP

SEQ ID NO: 10351 - protein, 9 aa, Canis lupus familiaris
SGRTERTWL

SEQ ID NO: 10352 - protein, 27 aa, Canis lupus familiaris
SGSFRSFYEGIVHSKGPSGMDLFNAVQ

SEQ ID NO: 10353 - protein, 8 aa, Canis lupus familiaris
SHLGRRHL

SEQ ID NO: 10354 - protein, 16 aa, Canis lupus familiaris
SHQFLSLQFLSTFNAS

SEQ ID NO: 10355 - protein, 26 aa, Canis lupus familiaris
SHSILFGTDIVFLFFGGYFRNYKLHA

SEQ ID NO: 10356 - protein, 11 aa, Canis lupus familiaris
SICPWYWNEWK

SEQ ID NO: 10357 - protein, 17 aa, Canis lupus familiaris
SIGEQKYLQASFGCILP

SEQ ID NO: 10358 - protein, 11 aa, Canis lupus familiaris
SKLWECGGATH

SEQ ID NO: 10359 - protein, 24 aa, Canis lupus familiaris
SKRLWRPSCCTYISCFKWQKYLQL

SEQ ID NO: 10360 - protein, 36 aa, Canis lupus familiaris
SLCHCAGSRNVWKTCLGTTTLPFTQRSKSKSEAFCT

SEQ ID NO: 10361 - protein, 32 aa, Canis lupus familiaris
SLQFLHLRNLIHNSMHSQILVQYNNWRQHYYV

SEQ ID NO: 10362 - protein, 12 aa, Canis lupus familiaris
SLSQTGHRFWIC

SEQ ID NO: 10363 - protein, 36 aa, Canis lupus familiaris
SLYSWGWQGSVHWHCPPLECLPGHHHQPQELQVGSA

SEQ ID NO: 10364 - protein, 37 aa, Canis lupus familiaris
SPGSNNARTRYAVLARRARHIQGSEDGTFRSQHQKLP

SEQ ID NO: 10365 - protein, 32 aa, Canis lupus familiaris
SPQFLHLRNLIHNSMHSQILVQYNNWRQHYYV

SEQ ID NO: 10366 - protein, 14 aa, Canis lupus familiaris
SPVHDGMQLFLDAL

SEQ ID NO: 10367 - skipped

SEQ ID NO: 10368 - protein, 8 aa, Canis lupus familiaris
SQNEVYPN

SEQ ID NO: 10369 - protein, 15 aa, Canis lupus familiaris
SQNKPRSYWVLSCKL

SEQ ID NO: 10370 - protein, 9 aa, Canis lupus familiaris
SRAYGVFCN

SEQ ID NO: 10371 - protein, 10 aa, Canis lupus familiaris
SRLPEATLLP

SEQ ID NO: 10372 - protein, 11 aa, Canis lupus familiaris
SRSKNSHCPTL

SEQ ID NO: 10373 - protein, 41 aa, Canis lupus familiaris
SSILYSWLLRQWETLSDKPTMGAHLPGKCLGLYLLRREPRL

SEQ ID NO: 10374 - protein, 12 aa, Canis lupus familiaris
SSVYSISCGYYG

SEQ ID NO: 10375 - protein, 8 aa, Canis lupus familiaris
STRHTDLE

SEQ ID NO: 10376 - protein, 31 aa, Canis lupus familiaris
STSEFRNQEIFRYQRFLSKHGEGTFHQNLQQ

SEQ ID NO: 10377 - protein, 12 aa, Canis lupus familiaris
STVQQMEQPFWP

SEQ ID NO: 10378 - protein, 8 aa, Canis lupus familiaris
SVFPVLHR

SEQ ID NO: 10379 - protein, 35 aa, Canis lupus familiaris
SWRTRKSLEQTHYRRESWVLYNQIAKFMSSCFKRE

SEQ ID NO: 10380 - protein, 40 aa, Canis lupus familiaris
SWSNIFNSKSNCLGESNIYCNTTVGLTTMASSEKENHTVL

SEQ ID NO: 10381 - protein, 12 aa, Canis lupus familiaris
SYCAQTNSTRVF

SEQ ID NO: 10382 - protein, 11 aa, Canis lupus familiaris
WFLKRRNNSTI

SEQ ID NO: 10383 - protein, 28 aa, Canis lupus familiaris
WFLRSLCITCESECCISGYGRFKYNFSR

SEQ ID NO: 10384 - protein, 16 aa, Canis lupus familiaris
WGLCRCGVSHVGCHGL

SEQ ID NO: 10385 - protein, 17 aa, Canis lupus familiaris
WHCPSAHGREGKGRGGW

SEQ ID NO: 10386 - protein, 34 aa, Canis lupus familiaris
WHCSHLFNSWGNKKEEASLPLPYYSIKLYLHLPV

SEQ ID NO: 10387 - protein, 15 aa, Canis lupus familiaris
WIRSARENIRIGVPY

SEQ ID NO: 10388 - protein, 49 aa, Canis lupus familiaris
WIRTLCLYAPQHWQFCGPGQDSISLLYSGDPDVESSNLQSEEQGNQRCP

SEQ ID NO: 10389 - skipped

SEQ ID NO: 10390 - protein, 10 aa, Canis lupus familiaris
WNIFNKYSEN

SEQ ID NO: 10391 - protein, 15 aa, Canis lupus familiaris
WNWFHCRQPCNEGAA

SEQ ID NO: 10392 - skipped

SEQ ID NO: 10393 - protein, 23 aa, Canis lupus familiaris
WRKSYLRFDRFYSDSKKKFTWFL

SEQ ID NO: 10394 - protein, 12 aa, Canis lupus familiaris
WSLLSSYWLYHF

SEQ ID NO: 10395 - protein, 9 aa, Canis lupus familiaris
WTCLQLLYI

SEQ ID NO: 10396 - protein, 31 aa, Canis lupus familiaris
WTQILENRIIFHRFYLHGILLLHTDYKTDTY

SEQ ID NO: 10397 - protein, 9 aa, Canis lupus familiaris
WTYGSCCNF

SEQ ID NO: 10398 - protein, 26 aa, Canis lupus familiaris
WVFSVVPWCVFGHKKSRKGTSATVLH

SEQ ID NO: 10399 - protein, 9 aa, Canis lupus familiaris
WWWVGAGSC

SEQ ID NO: 10400 - protein, 13 aa, Canis lupus familiaris
YALFFQLCTQQMF

SEQ ID NO: 10401 - protein, 16 aa, Canis lupus familiaris
YCHGDYRILHAGCNGL

SEQ ID NO: 10402 - protein, 9 aa, Canis lupus familiaris
YCQCEHFGE

SEQ ID NO: 10403 - protein, 16 aa, Canis lupus familiaris
YDFCRDGWFPPDRDGL

SEQ ID NO: 10404 - protein, 52 aa, Canis lupus familiaris
YDSRAGGGEGAVLQRRSHQLRTGLEVQSSCQPRYWLQARFQLLEGQEICGRH

SEQ ID NO: 10405 - protein, 12 aa, Canis lupus familiaris
YDSRRSRIRGEH

SEQ ID NO: 10406 - protein, 17 aa, Canis lupus familiaris
YGDGIQKILCYGICEVL

SEQ ID NO: 10407 - protein, 16 aa, Canis lupus familiaris
YGFWRHGHFPPYCDGL

SEQ ID NO: 10408 - protein, 10 aa, Canis lupus familiaris
YHLISCRGCW

SEQ ID NO: 10409 - protein, 19 aa, Canis lupus familiaris
YICLAVHISCFSGACHDLC

SEQ ID NO: 10410 - protein, 15 aa, Canis lupus familiaris
YICPGNTGGVCSSGL

SEQ ID NO: 10411 - skipped

SEQ ID NO: 10412 - protein, 21 aa, Canis lupus familiaris
YKRYLSGLEPVIERQKGRTGE

SEQ ID NO: 10413 - skipped

SEQ ID NO: 10414 - protein, 11 aa, Canis lupus familiaris
YQERASTKWWK

SEQ ID NO: 10415 - protein, 60 aa, Canis lupus familiaris
YQQFHGCLSFYVCGSLLLDQTSNHWHCKHHFILWVHDGYGPDFLPFHRDDWIFFLFLVSY

SEQ ID NO: 10416 - protein, 23 aa, Canis lupus familiaris
YQQHSQFGGAARLRPAQSRRLAL

SEQ ID NO: 10417 - protein, 14 aa, Canis lupus familiaris
YQRQPKVRAVQSST

SEQ ID NO: 10418 - protein, 16 aa, Canis lupus familiaris
YREPGSEKWQCFSHTL

SEQ ID NO: 10419 - protein, 15 aa, Canis lupus familiaris
YRKVLAGAPRRPGED

SEQ ID NO: 10420 - protein, 20 aa, Canis lupus familiaris
YSCYHTHHHPHKVWIYSSQR

SEQ ID NO: 10421 - protein, 41 aa, Canis lupus familiaris
YSLLCGGRDIGNSYSQATLFQEFLELSGCCDHCAVSGRYRN

SEQ ID NO: 10422 - protein, 16 aa, Canis lupus familiaris
YTLCCLRLLCPQCDGL

SEQ ID NO: 10423 - protein, 10 aa, Canis lupus familiaris
YTVHLSSLMV

SEQ ID NO: 10424 - protein, 24 aa, Canis lupus familiaris
YYGWQCLVGNSYHHMVLGSCAKVG

SEQ ID NO: 10425 - skipped

SEQ ID NO: 10426 - protein, 11 aa, Canis lupus familiaris
CEWKKGHREEC

SEQ ID NO: 10427 - protein, 18 aa, Canis lupus familiaris
CGRNKKEHDFIPSPPLGS

SEQ ID NO: 10428 - protein, 36 aa, Canis lupus familiaris
CGVPVVLHSGLCTNSLDPFHCRLCDHALCSTWECCQ

SEQ ID NO: 10429 - protein, 77 aa, Canis lupus familiaris
CGVPVVLHSGLCTNSLDPFHCRLCDHALWSWICAVLLSSYCHGWQVFQQTESSRLWDCHVGKWHWHLHIGSCGSTPY

SEQ ID NO: 10430 - skipped

SEQ ID NO: 10431 - protein, 12 aa, Canis lupus familiaris
CQTQARTNGYNC

SEQ ID NO: 10432 - protein, 8 aa, Canis lupus familiaris
CSLHFHVC

SEQ ID NO: 10433 - protein, 8 aa, Canis lupus familiaris
CSLHLHVC

SEQ ID NO: 10434 - protein, 11 aa, Canis lupus familiaris
FAGLHSRQTLF

SEQ ID NO: 10435 - protein, 9 aa, Canis lupus familiaris
FALCSRKNL

SEQ ID NO: 10436 - protein, 14 aa, Canis lupus familiaris
FATGSTPVGLFPVE

SEQ ID NO: 10437 - protein, 29 aa, Canis lupus familiaris
FCFVFLAVVLQGARQLRPRVGKWRASWSP

SEQ ID NO: 10438 - protein, 8 aa, Canis lupus familiaris
FCGTFHVI

SEQ ID NO: 10439 - protein, 13 aa, Canis lupus familiaris
FCHRVNASRAVPS

SEQ ID NO: 10440 - protein, 68 aa, Canis lupus familiaris
FCRASLQTDSLLAVVIQFQISTCQARLRISLRKQLLLFLVAKKTKQDILTHIIECLKKMKKFTSLGMI

SEQ ID NO: 10441 - protein, 19 aa, Canis lupus familiaris
FCSCYYSGSRQRSSQSHPI

SEQ ID NO: 10442 - protein, 38 aa, Canis lupus familiaris
FDHLCGHGVWQHAHCGHYHLQSHAGFPHVLFPGQLVLY

SEQ ID NO: 10443 - protein, 29 aa, Canis lupus familiaris
FEEKWGSSIPAKQSWRKHDVRNFSECRIR

SEQ ID NO: 10444 - protein, 14 aa, Canis lupus familiaris
FELCDVQFSMGPSR

SEQ ID NO: 10445 - protein, 14 aa, Canis lupus familiaris
FERLWERPDSRIRF

SEQ ID NO: 10446 - protein, 13 aa, Canis lupus familiaris
FFFFFFFFFYSYR

SEQ ID NO: 10447 - skipped

SEQ ID NO: 10448 - protein, 9 aa, Canis lupus familiaris
FGEQNILDL

SEQ ID NO: 10449 - skipped

SEQ ID NO: 10450 - protein, 9 aa, Canis lupus familiaris
FGKNGKMNG

SEQ ID NO: 10451 - protein, 17 aa, Canis lupus familiaris
FHCVWMPGQFTPDRDGL

SEQ ID NO: 10452 - protein, 9 aa, Canis lupus familiaris
FHHLGIALP

SEQ ID NO: 10453 - protein, 42 aa, Canis lupus familiaris
FHLECPRMLLQDPPWRSWCLVCQTCQNVSPPGSVCPLRSSQK

SEQ ID NO: 10454 - protein, 48 aa, Canis lupus familiaris
FHQNFKPPVSAQLQFASLAKLLGGRAPAASGVPGQVLQGGARSMAVQK

SEQ ID NO: 10455 - protein, 14 aa, Canis lupus familiaris
FICCGPFDFSRFKS

SEQ ID NO: 10456 - protein, 11 aa, Canis lupus familiaris
FIFFSFTEAHL

SEQ ID NO: 10457 - protein, 44 aa, Canis lupus familiaris
FILEQEDHKVYHVGRLCLSFKPLTNFDSGKQQAETDSLEGTVAS

SEQ ID NO: 10458 - protein, 25 aa, Canis lupus familiaris
FILFYFLFSFFFFFLFFFLSPKLIL

SEQ ID NO: 10459 - protein, 11 aa, Canis lupus familiaris
FILIAKLAKTG

SEQ ID NO: 10460 - protein, 19 aa, Canis lupus familiaris
FILILSTSQELCVTYVKEV

SEQ ID NO: 10461 - protein, 30 aa, Canis lupus familiaris
FIQLRRCRKKGCKLEVFPVAKASNAKASQS

SEQ ID NO: 10462 - protein, 30 aa, Canis lupus familiaris
FIRMCALSHPNFYISSTVCFLNKHCMTACT

SEQ ID NO: 10463 - protein, 11 aa, Canis lupus familiaris
FITQSKGRIEN

SEQ ID NO: 10464 - protein, 12 aa, Canis lupus familiaris
FKTHTDSENHGP

SEQ ID NO: 10465 - protein, 20 aa, Canis lupus familiaris
FLCESNGSLDCDRKLSGIWT

SEQ ID NO: 10466 - protein, 8 aa, Canis lupus familiaris
FLCQHGSH

SEQ ID NO: 10467 - protein, 17 aa, Canis lupus familiaris
FLCVWMPGQFTPDRDGL

SEQ ID NO: 10468 - protein, 17 aa, Canis lupus familiaris
FLDSPVHHDWVLLNHHS

SEQ ID NO: 10469 - protein, 9 aa, Canis lupus familiaris
FLEFLCSPA

SEQ ID NO: 10470 - protein, 30 aa, Canis lupus familiaris
FLFFFFFFFLLLQVSEYCAFMGLFFMKQSV

SEQ ID NO: 10471 - protein, 17 aa, Canis lupus familiaris
FLFFLSFSFSFFFPIVW

SEQ ID NO: 10472 - protein, 57 aa, Canis lupus familiaris
FLFHSQIWILYSIIHTYHPVQPLPTGSTFLQSSCLWGEDQTHPRESSKNVPLQRPGL

SEQ ID NO: 10473 - protein, 23 aa, Canis lupus familiaris
FLGLYTDLRFVLIILLNFSVLGK

SEQ ID NO: 10474 - protein, 38 aa, Canis lupus familiaris
FLGRESEIFLGLKNNGEPQIEDCFGGIKILFALSPILL

SEQ ID NO: 10475 - protein, 22 aa, Canis lupus familiaris
FLHFLMRWHINLIRRWTSFWEI

SEQ ID NO: 10476 - protein, 33 aa, Canis lupus familiaris
FLKILNIMSVPFLFWCTFRAEWASSCRMWICPT

SEQ ID NO: 10477 - skipped

SEQ ID NO: 10478 - protein, 10 aa, Canis lupus familiaris
FLKSSPRFPM

SEQ ID NO: 10479 - protein, 47 aa, Canis lupus familiaris
FLKWRSFVPGRQPALTSSTGARHTRIKNLLLSPWLSTLFGVEETTPS

SEQ ID NO: 10480 - protein, 10 aa, Canis lupus familiaris
FLKWRSLMIW

SEQ ID NO: 10481 - protein, 8 aa, Canis lupus familiaris
FLLFLCLF

SEQ ID NO: 10482 - protein, 27 aa, Canis lupus familiaris
FLQLLLLWIQTALIPISSYLRIENKFL

SEQ ID NO: 10483 - protein, 18 aa, Canis lupus familiaris
FLRCSSSSICRRDSTIFF

SEQ ID NO: 10484 - protein, 19 aa, Canis lupus familiaris
FLRFLRIMKQWHRFCSAGI

SEQ ID NO: 10485 - protein, 40 aa, Canis lupus familiaris
FLTAKFKMGLKVFVSSTPEKADRVARLLLNLNQKMKSNWP

SEQ ID NO: 10486 - protein, 84 aa, Canis lupus familiaris
FLTVFETFPHDTKLVLEPLGSDSEHPDCAVLLLCSARSDPVQFYLCADRLHPVNSDLSGCSFLLGNGLQAFGHCLGGLSSWNPH

SEQ ID NO: 10487 - protein, 15 aa, Canis lupus familiaris
FLVMEPLLRSLILAS

SEQ ID NO: 10488 - protein, 18 aa, Canis lupus familiaris
FLYNWCNHRMFSAGNNGI

SEQ ID NO: 10489 - protein, 25 aa, Canis lupus familiaris
FMALTTLGQNFSMHIISVRLMPRLH

SEQ ID NO: 10490 - protein, 10 aa, Canis lupus familiaris
FMETSSQRSL

SEQ ID NO: 10491 - protein, 29 aa, Canis lupus familiaris
FPCGVLNIWTYLITSYLTYHPPGSGPFLH

SEQ ID NO: 10492 - protein, 37 aa, Canis lupus familiaris
FPFSLTDLDLIFHHTYISPCPTFTYWFHLSSILLSMG

SEQ ID NO: 10493 - protein, 15 aa, Canis lupus familiaris
FPGDSGVYPPGSDVL

SEQ ID NO: 10494 - protein, 14 aa, Canis lupus familiaris
FPGEIADTEGSLED

SEQ ID NO: 10495 - protein, 8 aa, Canis lupus familiaris
FPKKICII

SEQ ID NO: 10496 - protein, 23 aa, Canis lupus familiaris
FPKWAFWPSRSAGRDLRIPSSRV

SEQ ID NO: 10497 - protein, 25 aa, Canis lupus familiaris
FPNMQIHLSLLFMIALLRLEKMLLM

SEQ ID NO: 10498 - protein, 26 aa, Canis lupus familiaris
FPNRSATIHLSLHVMLSLEILFSGKM

SEQ ID NO: 10499 - protein, 34 aa, Canis lupus familiaris
FPPCWRGGCIFFVSDGIGSICGHLQAPALCDHYE

SEQ ID NO: 10500 - protein, 23 aa, Canis lupus familiaris
FPRDSIFPAEAAIAEDLVCGQLQ

SEQ ID NO: 10501 - protein, 13 aa, Canis lupus familiaris
FQFAEWKNFNTSR

SEQ ID NO: 10502 - protein, 21 aa, Canis lupus familiaris
FQIHKYRSTKIQILIAGLFYI

SEQ ID NO: 10503 - protein, 10 aa, Canis lupus familiaris
FQIHLHYVQI

SEQ ID NO: 10504 - protein, 9 aa, Canis lupus familiaris
FQKCINTNS

SEQ ID NO: 10505 - protein, 9 aa, Canis lupus familiaris
FQPCYLLFT

SEQ ID NO: 10506 - protein, 8 aa, Canis lupus familiaris
FQRIFLVE

SEQ ID NO: 10507 - protein, 45 aa, Canis lupus familiaris
FQRKVLLAADPGWAPGVTAAGTDAPLLAGPAAAAGQRGRCVRAHQ

SEQ ID NO: 10508 - protein, 48 aa, Canis lupus familiaris
FQSGLFGPQEAQVEISGSPAQGYSDQVILQARLLLANAPRWSSRWNQG

SEQ ID NO: 10509 - protein, 31 aa, Canis lupus familiaris
FQSRIPSKKCSLRKSTKSYKSCTSLKSLVPT

SEQ ID NO: 10510 - protein, 12 aa, Canis lupus familiaris
FQTCKYTYHCCS

SEQ ID NO: 10511 - protein, 10 aa, Canis lupus familiaris
FRMRKWKDQI

SEQ ID NO: 10512 - protein, 10 aa, Canis lupus familiaris
FRRHACKNHL

SEQ ID NO: 10513 - protein, 8 aa, Canis lupus familiaris
FRRVGEVP

SEQ ID NO: 10514 - protein, 15 aa, Canis lupus familiaris
FRTGQPPSTYLCMSC

SEQ ID NO: 10515 - protein, 36 aa, Canis lupus familiaris
FRTIYFNYHHRWKQVNKYCWCSRRASSSFEFSSARK

SEQ ID NO: 10516 - protein, 14 aa, Canis lupus familiaris
FRYTNTGAPRSKFL

SEQ ID NO: 10517 - protein, 11 aa, Canis lupus familiaris
FSASMVLIHQH

SEQ ID NO: 10518 - protein, 27 aa, Canis lupus familiaris
FSDIGYLTLPFCLDPYIKRPRKPPMAP

SEQ ID NO: 10519 - protein, 14 aa, Canis lupus familiaris
FSEGFNISCRGGHR

SEQ ID NO: 10520 - protein, 14 aa, Canis lupus familiaris
FSFCLCGVPFLLQM

SEQ ID NO: 10521 - skipped

SEQ ID NO: 10522 - protein, 10 aa, Canis lupus familiaris
FSFQCFYFCM

SEQ ID NO: 10523 - protein, 8 aa, Canis lupus familiaris
FSHQHGRN

SEQ ID NO: 10524 - protein, 9 aa, Canis lupus familiaris
FSKESTSGG

SEQ ID NO: 10525 - protein, 46 aa, Canis lupus familiaris
FSLCFLRKAQGRRKPKHLLRGLEELNTTMPFFASFFCSSFSTLEPR

SEQ ID NO: 10526 - protein, 12 aa, Canis lupus familiaris
FSLCLDAWTIYS

SEQ ID NO: 10527 - protein, 32 aa, Canis lupus familiaris
FSLQLVQPQNVFCWQQWHMIAMWPYASLYFIQ

SEQ ID NO: 10528 - protein, 59 aa, Canis lupus familiaris
FSLRFRRGLRHLARKGLLREKRVQSAQLCFKMHIYRAHRAFLPEELLGHWHNPVLLVEP

SEQ ID NO: 10529 - protein, 13 aa, Canis lupus familiaris
FSLSAWVSLSASF

SEQ ID NO: 10530 - protein, 79 aa, Canis lupus familiaris
FSLVISFLLRVYTRRQICITFLHNSFHILCLWTESHICTSNICVSNPCFSCSTVTDTSITSGPQPSQTAASCFASHTAT

SEQ ID NO: 10531 - protein, 77 aa, Canis lupus familiaris
FSMISVLEAAFFFPEEPSFIIHLWISYERSITDVTSQKCSLPTCSTANSGKPQATGSITARTCLPLILKRILLLLSP

SEQ ID NO: 10532 - protein, 13 aa, Canis lupus familiaris
FSPPTENMKQVSK

SEQ ID NO: 10533 - protein, 31 aa, Canis lupus familiaris
FSPPTFRRTIPQQPALKNFQKPHGKHISQGL

SEQ ID NO: 10534 - protein, 28 aa, Canis lupus familiaris
FSPPWDCSTITGTHHRCLWEIPSVTLLA

SEQ ID NO: 10535 - protein, 24 aa, Canis lupus familiaris
FSQESLQRNVHSGRVQNLTRVVPV

SEQ ID NO: 10536 - protein, 9 aa, Canis lupus familiaris
FSQLRMHRK

SEQ ID NO: 10537 - protein, 21 aa, Canis lupus familiaris
FSRRNRRYRRISGGLKMSLQA

SEQ ID NO: 10538 - protein, 10 aa, Canis lupus familiaris
FSSMFFFEYM

SEQ ID NO: 10539 - protein, 55 aa, Canis lupus familiaris
FSSVSLSFLNPISCQRWHMTAMSPSVNHCCTRSPCLLRCVYSSCWVFMGWGCLGL

SEQ ID NO: 10540 - protein, 14 aa, Canis lupus familiaris
FSTLLEGWMYFLCQ

SEQ ID NO: 10541 - protein, 12 aa, Canis lupus familiaris
FSWGQWSLSSWQ

SEQ ID NO: 10542 - protein, 13 aa, Canis lupus familiaris
FSWNQDVRPRNYF

SEQ ID NO: 10543 - protein, 11 aa, Canis lupus familiaris
FSWRVFLDTRS

SEQ ID NO: 10544-10545 - skipped (2 entries)

SEQ ID NO: 10546 - protein, 20 aa, Canis lupus familiaris
FTSLCFSGCLPRHSLSSMES

SEQ ID NO: 10547 - protein, 14 aa, Canis lupus familiaris
FTTAWSEICCLWQH

SEQ ID NO: 10548 - protein, 8 aa, Canis lupus familiaris
FTVPVGTA

SEQ ID NO: 10549 - protein, 18 aa, Canis lupus familiaris
FVDLFLHCYHEENLQVPP

SEQ ID NO: 10550 - protein, 11 aa, Canis lupus familiaris
FVGTRTSSSEK

SEQ ID NO: 10551 - protein, 9 aa, Canis lupus familiaris
FWRSWDSRT

SEQ ID NO: 10552 - skipped

SEQ ID NO: 10553 - protein, 12 aa, Canis lupus familiaris
FWVYTQISGLSL

SEQ ID NO: 10554 - protein, 24 aa, Canis lupus familiaris
FYFGTRRSQSLSCWPFMSFLQATH

SEQ ID NO: 10555 - protein, 25 aa, Canis lupus familiaris
FYFILFFILFLFLFFIFFSFTEAHL

SEQ ID NO: 10556 - protein, 17 aa, Canis lupus familiaris
FYGNELSKIALNMFGDP

SEQ ID NO: 10557 - protein, 9 aa, Canis lupus familiaris
FYHTEQGAD

SEQ ID NO: 10558 - protein, 14 aa, Canis lupus familiaris
FYSASGHGVRITIN

SEQ ID NO: 10559 - protein, 20 aa, Canis lupus familiaris
LALLSQRKSSTYKLPHLQSP

SEQ ID NO: 10560 - protein, 40 aa, Canis lupus familiaris
LAMWPSCTYASLPPTPYSGIQSLLWPLQFCLPSSTPSFIA

SEQ ID NO: 10561 - protein, 24 aa, Canis lupus familiaris
LASIPLFPCQWCTFFPRKSLMIRL

SEQ ID NO: 10562 - protein, 30 aa, Canis lupus familiaris
LATLRNCSALLMILHSLPGDLFLIHYMEIF

SEQ ID NO: 10563 - protein, 10 aa, Canis lupus familiaris
LCRNMKQQIC

SEQ ID NO: 10564 - protein, 51 aa, Canis lupus familiaris
LCSHCSCWGPWCCTSATTRSTWPLWCSPWPWAGPTCSTTPAASSRWASMLL

SEQ ID NO: 10565 - protein, 36 aa, Canis lupus familiaris
LDQQHSCILNILLLDLWSREKFLQCSILMWDPCSIP

SEQ ID NO: 10566 - protein, 53 aa, Canis lupus familiaris
LESLRVSPRCRPQTGAPCGLCSLSTGATASCTSTRNAHIWLFQNQKGRNTNAR

SEQ ID NO: 10567 - protein, 11 aa, Canis lupus familiaris
LFFFLSPKLIL

SEQ ID NO: 10568 - protein, 20 aa, Canis lupus familiaris
LFPAFACMLDLFLTCPLISL

SEQ ID NO: 10569 - protein, 20 aa, Canis lupus familiaris
LFPAFSCMLDLFLTCPLISL

SEQ ID NO: 10570 - protein, 75 aa, Canis lupus familiaris
LFSFPCWNYWERICNLGFRTKQDKSQVCEHILDQFADSRFPAHPGITSENRCRPGSGTLEAEDLPLPSDSLPHVH

SEQ ID NO: 10571 - protein, 52 aa, Canis lupus familiaris
LGGPAGRRGCPSHTGAPGWRIVTAATAWTATGTAARCGVAISLACWPAGPNP

SEQ ID NO: 10572 - protein, 20 aa, Canis lupus familiaris
LGNRISSISELWSYRSNCWT

SEQ ID NO: 10573 - protein, 26 aa, Canis lupus familiaris
LKRRYANALGIVTIPSLLLLFLLLSS

SEQ ID NO: 10574 - protein, 12 aa, Canis lupus familiaris
LLHTSSSRGFKS

SEQ ID NO: 10575 - skipped

SEQ ID NO: 10576 - protein, 24 aa, Canis lupus familiaris
LLRRMPMLPSSPVSQRRFGGPPSP

SEQ ID NO: 10577 - protein, 9 aa, Canis lupus familiaris
LLVSLAMCR

SEQ ID NO: 10578 - protein, 26 aa, Canis lupus familiaris
LMKSMVWLQYDQAGKIRFTVPLFPPC

SEQ ID NO: 10579 - protein, 15 aa, Canis lupus familiaris
LNWCEIIYRLEFPLI

SEQ ID NO: 10580 - protein, 63 aa, Canis lupus familiaris
LPLCVFLDACQGTPYPLWNPDCFPYGAQISTGGSSLFGWLRGPSAHCCCHGCCHGAQKGLPTA

SEQ ID NO: 10581 - protein, 85 aa, Canis lupus familiaris
LQMLTGIDYIEEKFNLLSNLLLENQMILFVLILSLLQKHLKILLVCQLVLTLINSSKDSALLQRLLQRNIKSLLSQVQMCYQLFR

SEQ ID NO: 10582 - protein, 13 aa, Canis lupus familiaris
LRILSIYPRETQR

SEQ ID NO: 10583 - skipped

SEQ ID NO: 10584 - protein, 11 aa, Canis lupus familiaris
LRRQTLWNIDM

SEQ ID NO: 10585 - protein, 18 aa, Canis lupus familiaris
LSPEILPKHHRKSGCSGN

SEQ ID NO: 10586 - skipped

SEQ ID NO: 10587 - protein, 22 aa, Canis lupus familiaris
LTLNSLRWLLQLLNLAGSQISW

SEQ ID NO: 10588 - protein, 11 aa, Canis lupus familiaris
LTTLLFVGIEE

SEQ ID NO: 10589 - protein, 8 aa, Canis lupus familiaris
LVFLQQRF

SEQ ID NO: 10590 - protein, 11 aa, Canis lupus familiaris
LVNGPWFSITF

SEQ ID NO: 10591 - protein, 27 aa, Canis lupus familiaris
LWESLHSEVTPQRTSKNTYWRETLCVQ

SEQ ID NO: 10592 - protein, 21 aa, Canis lupus familiaris
LWSSSRTSLRIMHKQLGSIPL

SEQ ID NO: 10593 - protein, 8 aa, Canis lupus familiaris
SELSIPAV

SEQ ID NO: 10594 - protein, 19 aa, Canis lupus familiaris
SLFAYVVSLFYYKCNFSFV

SEQ ID NO: 10595 - protein, 54 aa, Canis lupus familiaris
SLFNAFIFVCSKLNGNLYHKRNCVCFGYIHARLCSFTCLPNICDILYFSQDEKK

SEQ ID NO: 10596 - skipped

SEQ ID NO: 10597 - protein, 12 aa, Canis lupus familiaris
SRSIYIMFRYNR

SEQ ID NO: 10598 - protein, 15 aa, Canis lupus familiaris
SVHPHSGEQFHSSLL

SEQ ID NO: 10599 - protein, 21 aa, Canis lupus familiaris
WEALLVAGVALRTRELLGGGL

SEQ ID NO: 10600 - protein, 43 aa, Canis lupus familiaris
WHCSVSGKALHTNYHTYNLHEPKCISGSGDAIHAESVHHHFPP

SEQ ID NO: 10601 - protein, 19 aa, Canis lupus familiaris
WHQFHCFLVSGVLSFQGKA

SEQ ID NO: 10602 - protein, 8 aa, Canis lupus familiaris
WISSIHVS

SEQ ID NO: 10603 - protein, 11 aa, Canis lupus familiaris
WLPSGTAQLCL

SEQ ID NO: 10604 - protein, 63 aa, Canis lupus familiaris
WNHCVSLPGVVHRQERLVGFAHFLRGRLPAAPQQEMHTSGCSRTKRGEIRMRVKESKYQNCYP

SEQ ID NO: 10605 - protein, 38 aa, Canis lupus familiaris
WQCGPHVPTLLCHLLLILGYSHCSGLCSFVSLLQPHHL

SEQ ID NO: 10606 - protein, 38 aa, Canis lupus familiaris
WQQLKLLVAQAHLHRCCFLLVRKEADTVLGQVHSCGYR

SEQ ID NO: 10607 - protein, 8 aa, Canis lupus familiaris
WSMDLGSV

SEQ ID NO: 10608 - skipped

SEQ ID NO: 10609 - protein, 15 aa, Canis lupus familiaris
YWDFSRCCTSLFCSN

SEQ ID NO: 10610 - protein, 24 aa, Canis lupus familiaris
YWSHWQCVDRQHNPLHPQDGDSRV

SEQ ID NO: 10611 - protein, 12 aa, Canis lupus familiaris
YYIRAAQEASNL

SEQ ID NO: 10612 - protein, 49 aa, Canis lupus familiaris
CGLNKSIAAPGCSLCDISLGLSCYSSGKCGDDHPHLVGSPTPHTYVLFS

SEQ ID NO: 10613 - protein, 21 aa, Canis lupus familiaris
CNVRQSERRNSLLPKQTRCLY

SEQ ID NO: 10614 - protein, 28 aa, Canis lupus familiaris
FAIDTVFFITFLYFSVNYLFSFYDASYF

SEQ ID NO: 10615 - protein, 23 aa, Canis lupus familiaris
FCCLCCCRPLCLCAATAPEEAAL

SEQ ID NO: 10616 - skipped

SEQ ID NO: 10617 - protein, 54 aa, Canis lupus familiaris
FCSSSSSSWRSSRRPSWPSSSGKISLASPSPRSSPSTTRATMTQTSSPPPGTPS

SEQ ID NO: 10618 - protein, 24 aa, Canis lupus familiaris
FEFSSHRSSDQKQKVSFPLLLPVG

SEQ ID NO: 10619 - protein, 11 aa, Canis lupus familiaris
FEKRSGTQVYH

SEQ ID NO: 10620 - protein, 13 aa, Canis lupus familiaris
FGKCDQPDVSDIR

SEQ ID NO: 10621 - protein, 23 aa, Canis lupus familiaris
FGRKHNFLLFMCHTGSFLHDLHH

SEQ ID NO: 10622 - protein, 21 aa, Canis lupus familiaris
FISDITGKMRGSPFLAQQTKA

SEQ ID NO: 10623 - protein, 16 aa, Canis lupus familiaris
FLEAGLWTLVYQRSRE

SEQ ID NO: 10624 - protein, 8 aa, Canis lupus familiaris
FLFYMYQR

SEQ ID NO: 10625 - protein, 97 aa, Canis lupus familiaris
FLGFQSMHMDKRYSGERWYLLDQYLVSTCSQWTPMPFMVLQHPFFWTVIRKVKTMDLCQSWTFVKKLNHKEFYQEEFQDSCRKDLLSLKTSVSLQAG

SEQ ID NO: 10626 - protein, 27 aa, Canis lupus familiaris
FLPASRVSKDCGTSGVLQEIFERELPS

SEQ ID NO: 10627 - protein, 8 aa, Canis lupus familiaris
FLSPKLIL

SEQ ID NO: 10628 - protein, 20 aa, Canis lupus familiaris
FLVKQTVQDSESKHERSSWQ

SEQ ID NO: 10629 - protein, 35 aa, Canis lupus familiaris
FMLLVYFVVIHLCQSHPVSALLSSMIRTQQLWHSI

SEQ ID NO: 10630 - protein, 9 aa, Canis lupus familiaris
FNLGYLNLF

SEQ ID NO: 10631 - protein, 12 aa, Canis lupus familiaris
FPEAIWISLFIG

SEQ ID NO: 10632 - protein, 41 aa, Canis lupus familiaris
FPERSAHWSLFVSTDPFCSAYTTKIRRTSSSGARSPTPIKP

SEQ ID NO: 10633 - protein, 24 aa, Canis lupus familiaris
FPFAFDFGVLYFNFMLYLGDVSTE

SEQ ID NO: 10634 - protein, 10 aa, Canis lupus familiaris
FQKNYPQLLI

SEQ ID NO: 10635 - protein, 14 aa, Canis lupus familiaris
FQLQSGTDTVLSIL

SEQ ID NO: 10636 - protein, 17 aa, Canis lupus familiaris
FQSPLEKTLQYQQNTTT

SEQ ID NO: 10637 - protein, 32 aa, Canis lupus familiaris
FRCLRHPSTCSRGWRTTAAPLCSPTFSPLFRA

SEQ ID NO: 10638 - protein, 41 aa, Canis lupus familiaris
FRKDRPTGHCSFQQTLSVLHTPQRYGEHPLLGQGHQPQSSL

SEQ ID NO: 10639 - protein, 32 aa, Canis lupus familiaris
FRKKKWNTGVPLTRCPRNTKVPFCREQRNPYP

SEQ ID NO: 10640 - protein, 8 aa, Canis lupus familiaris
FSFTEAHL

SEQ ID NO: 10641 - protein, 14 aa, Canis lupus familiaris
FSGQADSSGFRIQA

SEQ ID NO: 10642 - protein, 20 aa, Canis lupus familiaris
FSILHVPKVTAVPSVTVKLH

SEQ ID NO: 10643 - protein, 18 aa, Canis lupus familiaris
FSKLGCGHWSIREAGSNL

SEQ ID NO: 10644 - protein, 19 aa, Canis lupus familiaris
FSKSTRKNTTISAKYNNMN

SEQ ID NO: 10645 - protein, 13 aa, Canis lupus familiaris
FSNHDRWKHNICV

SEQ ID NO: 10646 - protein, 17 aa, Canis lupus familiaris
FSRSHLDFSLYWMKKVR

SEQ ID NO: 10647 - protein, 21 aa, Canis lupus familiaris
FSSRFACLKGLWNLWSITGDF

SEQ ID NO: 10648 - protein, 14 aa, Canis lupus familiaris
FSTSKWHRHCAFHL

SEQ ID NO: 10649 - protein, 11 aa, Canis lupus familiaris
FTAGIHRTWKT

SEQ ID NO: 10650 - protein, 31 aa, Canis lupus familiaris
FTGTLITEVSYSAFILATHSGVQHLSSYLDL

SEQ ID NO: 10651 - protein, 19 aa, Canis lupus familiaris
FWKKTQFLIIYVPHRELST

SEQ ID NO: 10652 - protein, 25 aa, Canis lupus familiaris
FYMKRNLIHSFGMKYLPPIFTLGDQ

SEQ ID NO: 10653 - protein, 16 aa, Canis lupus familiaris
FYTLSLYGHLYMKVLP

SEQ ID NO: 10654 - protein, 30 aa, Canis lupus familiaris
LFFKIYFYRESGVWQGGGQKEREFQADSPL

SEQ ID NO: 10655 - skipped

SEQ ID NO: 10656 - protein, 12 aa, Canis lupus familiaris
LHHLSCFLNLNS

SEQ ID NO: 10657 - protein, 14 aa, Canis lupus familiaris
LLLISLTLLWGSKH

SEQ ID NO: 10658 - protein, 13 aa, Canis lupus familiaris
LLRAFIEHGRLRG

SEQ ID NO: 10659 - protein, 32 aa, Canis lupus familiaris
LSHLSYLRVQSIWRKLQMYFVFYKQSSLPCFL

SEQ ID NO: 10660 - protein, 8 aa, Canis lupus familiaris
LSQTLLER

SEQ ID NO: 10661 - protein, 15 aa, Canis lupus familiaris
LTPKRKLSSLILPLT

SEQ ID NO: 10662 - protein, 16 aa, Canis lupus familiaris
SIWVTSTCFSTDMGAS

SEQ ID NO: 10663 - protein, 8 aa, Canis lupus familiaris
SRKIIPNS

SEQ ID NO: 10664 - protein, 24 aa, Canis lupus familiaris
SSGSSPCTWTRDIQEKGGTFWTST

SEQ ID NO: 10665 - protein, 41 aa, Canis lupus familiaris
SVHPHHLLGGALGGHPGLHLQGKSHSRVLHQGAHQALPGQQ

SEQ ID NO: 10666 - protein, 59 aa, Mus musculus
TLCMEVMLRWNTRELGYLYLQLCFLNTHFLHTSQEEKLLTLGRFLTWTSRCGSFVIRPL

SEQ ID NO: 10667 - protein, 33 aa, Mus musculus
ICMSPPLLWATLQAPETTSAACKASYRPEGLYL

SEQ ID NO: 10668 - protein, 24 aa, Mus musculus
YFSCDKRCIKHYAGNKSLLTFSGY

SEQ ID NO: 10669 - DNA, 39 bp, Canis lupus familiaris
  CDS (1)..(39)
aaagaaaaaaaaaaagatggggaaaaggaagagcctaaa

SEQ ID NO: 10670 - protein, 13 aa, Canis lupus familiaris
KEKKKDGEKEEPK

SEQ ID NO: 10671 - DNA, 39 bp, Artificial Sequence
  Description of Artificial Sequence: Synthetic oligonucleotide
  CDS (1)..(39)
aaagaaaaaaaaaaaagatggggaaaaggaagagcctaa

SEQ ID NO: 10672 - protein, 12 aa, Artificial Sequence
  Description of Artificial Sequence: Synthetic peptide
KEKKKRWGKGRA

SEQ ID NO: 10673 - DNA, 39 bp, Artificial Sequence
  Description of Artificial Sequence: Synthetic oligonucleotide
  CDS (1)..(39)
aaagaaaaaaaaaagatggggaaaaggaagagcctaaaa

SEQ ID NO: 10674 - protein, 13 aa, Artificial Sequence
  Description of Artificial Sequence: Synthetic peptide
KEKKKMGKRKSLK

What is claimed is:

1. A method of treating an individual in need of treatment for a cancer, the method comprising:
    a) contacting a biological sample from the individual with a frameshift peptide (FSP) array, wherein the FSP array comprises a first population of peptides encoded by a frameshifted mRNA created in a splicing error or a transcription insertion or deletion error, wherein the first population of peptides comprising the peptide sequence of SEQ ID NO: 1;
    b) identifying peptides in the FSP array that are immunoreactive with the biological sample;
    c) preparing a vaccine composition comprising the immunoreactive peptides identified in step b) or a nucleic acid sequence encoding the immunoreactive peptides; and
    d) administering an effective amount of the vaccine composition to the individual, thereby treating the cancer, wherein the individual is a canine.

2. The method of claim 1, comprising obtaining the biological sample from the individual.

3. The method of claim 1, wherein treating the cancer comprises reducing tumor size, inhibiting tumor growth, reducing tumor burden, increasing survival, or increasing cancer-free survival.

4. The method of claim 1, wherein administering the vaccine composition elicits an immune response in the individual against the cancer.

5. The method of claim 1, wherein the immunoreactive peptides are a subpopulation of the first population of peptides.

6. The method of claim 1, wherein the identified peptide elicits a positive response in an antibody assay or a T cell assay performed on the biological sample from the individual.

7. The method of claim 1, wherein the biological sample is selected from the group consisting of blood, plasma, serum, thymus, bone marrow, spleen, lymph node, bronchoalveolar lavage, breast, central nervous system, cerebrospinal fluid, eye, tears, gastrointestinal tract, saliva, feces, urine, heart, kidney, liver, lung, muscle, pancreas, peripheral nervous system, saliva, skin, thyroid, trachea, and tumor.

8. The method of claim 1, wherein the biological sample comprises cells selected from B cells, T cells, CD4+ T cells, CD8+ T cells, Thl 7 cells, and combinations thereof.

9. The method of claim 1, wherein the biological sample comprises an antibody.

10. The method of claim 1, wherein identifying comprises determining immunoreactivity of the first population of peptides to the biological sample using antibody reactivity using an antibody assay selected from the group consisting of ELISA, radio-immunoassay, western blot, surface plasmon resonance, immunostaining, immunoprecipitation, mass spectrometry, phage display, ELISPOT, flow cytometry, cytometric bead array, immunohistochemistry, high density array, microarray, delayed-type hypersensitivity (DTH), and combinations thereof.

11. The method of claim 1, wherein identifying comprises determining immunoreactivity of the first population of peptides to the biological sample using a T cell response using an assay selected from the group consisting of proliferation assay, 3H-thymidine assay, BrdU assay, CFSE assay, cytokine secretion assay, ELISA assay, ELISPOT assay, intracellular staining assay, quantitative rtPCR assay, cytometric bead array assay, cytotoxicity assay, 51-chromium assay, degranulation assay, granulysin assay, granzyme A assay, granzyme B assay, and perforin assay.

12. The method of claim 1, wherein the first population of peptides comprises peptides encoded by a frameshifted mRNA expressed by a cancer cell.

13. The method of claim 1, wherein the first population of peptides is bound to a substrate.

14. The method of claim 1, wherein the vaccine composition comprises a pharmaceutically acceptable adjuvant or excipient.

15. The method of claim 14, wherein the adjuvant is selected from the group consisting of ABM2, AS01B, AS02, AS02A, Adjumer, Adjuvax, Algammulin, Alum, Aluminum phosphate, Aluminum potassium sulfate, *Bordetella pertussis*, Calcitriol, Chitosan, Cholera toxin, CpG, Dibutyl phthalate, Dimethyldioctadecylammonium bromide (DDA), Freund's adjuvant, Freund's complete, Freund's incomplete (IFA), GM-CSF, GMDP, Gamma Inulin, Glycerol, HBSS (Hank's Balanced Salt Solution), IL-12, IL-2, Imiquimod, InterferonGamma, ISCOM, Lipid Core Peptide (LCP), Lipofectin, Lipopolysaccharide (LPS), Liposomes, MF59, MLP+TDM, Monophosphoryl lipid A, Montanide IMS-1313, Montanide ISA 206, Montanide ISA 720, Montanide ISA-51, Montanide ISA-50, nor-MDP, Oil-in-water emulsion, Pl005 (non-ionic copolymer), Pam3Cys (lipoprotein), Pertussis toxin, Poloxamer, QS21, RaLPS, Ribi, Saponin, Seppic ISA 720, Soybean Oil, Squalene, Syntex Adjuvant Formulation (SAF), Synthetic polynucleotides (poly IC/poly AU), TiterMax Tomatine, Vaxfectin, XtendIII, and Zymosan.

16. The method of claim 1, wherein the vaccine is administered via a route selected from the group consisting of subcutaneous, intradermal, intramuscular, intranasal, intravenous, and sublingual.

17. The method of claim 1, wherein the individual is a dog.

18. The method of claim 1, wherein the cancer is selected from the group consisting of Acute lymphoblastic leukemia, Acute monocytic leukemia, Acute myeloid leukemia, Acute promyelocytic leukemia, Adenocarcinoma, Adult T-cell leukemia, Astrocytoma, Bladder cancer, Bone Cancer, Brain Tumor, Breast Cancer, Burkitt's lymphoma, Carcinoma, Cervical Cancer, Chronic Lymphocytic Leukemia, Chronic myelogenous leukemia, Colon Cancer, Colorectal cancer, Endometrial cancer, Glioblastoma multiforme, Glioma, Hepatocellular carcinoma, Hodgkin's lymphoma, Inflammatory breast cancer, Kidney Cancer, Leukemia, Lung cancer, Lymphoma, Malignant Mesothelioma, Medulloblastoma, Melanoma, Multiple myeloma, Neuroblastoma, Non-Hodgkin Lymphoma, Non-Small Cell Lung Cancer, Ovarian Cancer, Pancreatic Cancer, Pituitary tumor, Prostate cancer, Retinoblastoma, Skin Cancer, Small Cell Lung Cancer, Squamous cell carcinoma, Stomach cancer, T-cell leukemia, T-cell lymphoma, Thyroid cancer, and Wilms' tumor.

\* \* \* \* \*

UNITED STATES PATENT AND TRADEMARK OFFICE
CERTIFICATE OF CORRECTION

| | | |
|---|---|---|
| PATENT NO. | : 11,484,581 B2 | Page 1 of 12 |
| APPLICATION NO. | : 16/617889 | |
| DATED | : November 1, 2022 | |
| INVENTOR(S) | : Johnston et al. | |

It is certified that error appears in the above-identified patent and that said Letters Patent is hereby corrected as shown below:

In the Drawings

On Sheet 10 of 17, FIG. 13B, Y-Axis, Line 2, delete "Normallzed Antlbody Actlve" and insert --Normalized Antibody Active--.

On Sheet 12 of 17, FIG. 16A, X-Axis, Line 2, delete "innoculation" and insert --inoculation--.

On Sheet 12 of 17, FIG. 17A, Line 3 (Approx.), delete "Contorl" and insert --Control--.

On Sheet 13 of 17, FIG. 17B, Line 3 (Approx.), delete "Contorl" and insert --Control--.

In the Specification

In Column 2, Line 55, delete "XtendIII," and insert --Xtend III,--.

In Column 4, Line 55, delete "XtendIII," and insert --Xtend III,--.

In Column 6, Line 18, delete "XtendIII," and insert --Xtend III,--.

In Column 7, Line 61, delete "XtendIII," and insert --Xtend III,--.

In Column 9, Line 14, delete "II" and insert --I/II--.

In Column 10, Line 49, delete "sanle" and insert --same--.

In Column 13, Line 11, delete "and or" and insert --and/or--.

In Column 18, Line 18, delete "RNA" and insert --RNA.--.

In Column 20, Line 20, delete "(IFN-7)" and insert --(IFN-γ)--.

Signed and Sealed this
Eighteenth Day of April, 2023

Katherine Kelly Vidal
*Director of the United States Patent and Trademark Office*

CERTIFICATE OF CORRECTION (continued)
U.S. Pat. No. 11,484,581 B2

In Column 20, Line 20, delete "ethylcarvazole" and insert --ethylcarbazole--.

In Column 20, Line 31, delete "SI$\leq$2." and insert --SI$\geq$2.--.

In Column 20, Line 54, delete "tmle" and insert --tune--.

In Column 21, Line 54, delete "alcoHO1," and insert --alcohol,--.

In Column 23, Line 54, delete "SEQ IDNO: 1-10665." and insert --SEQ ID NO: 1-10665.--.

In Column 24, Lines 48-49, delete "antibacteRIA1," and insert --antibacterial,--.

In Column 25, Line 7, delete "XtendIII," and insert --Xtend III,--.

In Column 28, Line 9, delete "XtendIII," and insert --Xtend III,--.

In Column 29, Line 26, delete "gem1" and insert --germ--.

In Column 29, Line 58, delete "InvoMng" and insert --Involving--.

In Column 31, Line 35, delete "Acanthoina," and insert --Acanthoma,--.

In Column 33, Line 13, delete "Sezaiy" and insert --Sezary--.

In Column 33, Line 17, delete "wart." and insert --wart,--.

In Column 33, Line 23, delete "lymphocyle" and insert --lymphocyte--.

In Column 34, Line 16, delete "LH" and insert --LH,--.

In Column 35, Line 54, delete "A-13," and insert --A_13,--.

In Column 38, Line 17, delete "ClH," and insert --C1H,--.

In Column 38, Line 66, delete "MK167," and insert --MKI67,--.

In Column 41, Line 59, delete "XM 005639666.2," and insert --XM_005639666.2,--.

In Column 44, Line 17, delete "XM 014110659.1," and insert --XM_014110659.1,--.

In Column 45, Line 23, delete "A-7," and insert --A_7,--.

In Column 45, Line 38, delete "A-7," and insert --A_7,--.

In Column 45, Line 65, delete "A-7," and insert --A_7,--.

CERTIFICATE OF CORRECTION (continued)
U.S. Pat. No. 11,484,581 B2

In Column 46, Line 8, delete "LUC100683727," and insert --LOC100683727,--.

In Column 46, Line 55, delete "PiS," and insert --PLS,--.

In Column 47, Line 44, delete "A-7," and insert --A_7,--.

In Column 48, Line 47, delete "IPOS," and insert --IP05,--.

In Column 49, Line 51, delete "MK167," and insert --MKI67,--.

In Column 50, Line 1, delete "A-7," and insert --A_7,--.

In Column 50, Line 24, delete "TL1," and insert --TLI,--.

In Column 50, Line 30, delete "A-7," and insert --A_7,--.

In Column 50, Line 39, delete "A-7," and insert --A_7,--.

In Column 50, Line 57, delete "A-7," and insert --A_7,--.

In Column 54, Line 39, delete "XM 534297.5," and insert --XM_534297.5,--.

In Column 55, Line 43, delete "XM_005616994.2." and insert --XM_005616994.2,--.

In Column 56, Line 34, delete "C1IH" and insert --CLLH--.

In Column 60, Line 2, delete "QV" and insert --QV,--.

In Column 64, Line 25, delete "A-7," and insert --A_7,--.

In Column 64, Line 40, delete "XM 005624024.1," and insert --XM_005624024.1,--.

In Column 66, Line 36, delete "C1H-" and insert --CLH- --.

In Column 67, Line 11, delete "A-7," and insert --A_7,--.

In Column 67, Line 39, delete "C5H11orf141," and insert --C5H1orf141,--.

In Column 67, Line 40, delete "XM 005640597.2," and insert --XM_005640597.2,--.

In Column 68, Line 39, delete "A-7," and insert --A_7,--.

In Column 69, Line 56, delete "A-7," and insert --A_7,--.

In Column 75, Line 10, delete "A-7," and insert --A_7,--.

CERTIFICATE OF CORRECTION (continued)
U.S. Pat. No. 11,484,581 B2

In Column 77, Line 27, delete "A-7," and insert --A_7,--.

In Column 81, Line 54, delete "A-7," and insert --A_7,--.

In Column 83, Line 27, delete "PIPSK1A," and insert --PIP5K1A,--.

In Column 87, Line 15, delete "RHQ" and insert --RIIQ--.

In Column 87, Line 42, delete "FBX015," and insert --FBXO15,--.

In Column 88, Line 8, delete "MK167," and insert --MKI67,--.

In Column 88, Line 58, delete "A-7," and insert --A_7,--.

In Column 88, Line 67, delete "HlLL" and insert --HILL--.

In Column 90, Line 27, delete "A-7," and insert --A_7,--.

In Column 92, Line 54, delete "A-7," and insert --A_7,--.

In Column 93, Line 48, delete "CIS," and insert --CLS,--.

In Column 97, Line 17, delete "A-7," and insert --A_7,--.

In Column 97, Line 28, delete "A-7," and insert --A_7,--.

In Column 99, Line 25, delete "C16H2orf73," and insert --C10H2orf73,--.

In Column 100, Line 3, delete "A-7," and insert --A_7,--.

In Column 101, Line 35, delete "PTI" and insert --PTT--.

In Column 101, Line 49, delete "HI1," and insert --HL,--.

In Column 107, Line 35, delete "A-7," and insert --A_7,--.

In Column 110, Line 1, delete "SIL," and insert --SLL,--.

In Column 110, Line 14, delete "A-7," and insert --A_7,--.

In Column 110, Line 40, delete "A-7," and insert --A_7,--.

In Column 110, Line 63, delete "A-7," and insert --A_7,--.

In Column 111, Line 10, delete "ATP6VOD2," and insert --ATP6V0D2,--.

CERTIFICATE OF CORRECTION (continued)
U.S. Pat. No. 11,484,581 B2

In Column 112, Line 16, delete "A-8," and insert --A_8,--.

In Column 113, Line 39, delete "A-8," and insert --A_8,--.

In Column 114, Line 16, delete "G1H" and insert --GIH--.

In Column 114, Lines 64-65, delete "XM 005626849.2," and insert --XM_005626849.2,--.

In Column 115, Line 32, delete "A-8," and insert --A_8,--.

In Column 116, Line 17, delete "XM__005637551.2," and insert --XM_005637551.2,--.

In Column 116, Line 22, delete "A-8," and insert --A_8,--.

In Column 116, Line 57, delete "A-8," and insert --A_8,--.

In Column 117, Line 35, delete "CSNKIG3," and insert --CSNK1G3,--.

In Column 118, Line 15, delete "ID1," and insert --LDL,--.

In Column 118, Line 48, delete "FIA," and insert --FLA,--.

In Column 118, Line 61, delete "KHC" and insert --KIIC--.

In Column 119, Line 1, delete "TR." and insert --TR,--.

In Column 119, Line 13, delete "XM-850195.4," and insert --XM_850195.4,--.

In Column 120, Line 58, delete "A-8," and insert --A_8,--.

In Column 121, Line 17, delete "A-8," and insert --A_8,--.

In Column 121, Line 39, delete "XM-014108520.1," and insert --XM_014108520.1,--.

In Column 123, Line 9, delete "SSI," and insert --SSL,--.

In Column 123, Line 47, delete "A-8," and insert --A_8,--.

In Column 124, Line 25, delete "A-8," and insert --A_8,--.

In Column 126, Line 19, delete "PDSSB," and insert --PDS5B,--.

In Column 126, Line 45, delete "A-8," and insert --A_8,--.

In Column 127, Line 37, delete "A-8," and insert --A_8,--.

CERTIFICATE OF CORRECTION (continued)
U.S. Pat. No. 11,484,581 B2

In Column 127, Line 46, delete "A-8," and insert --A_8,--.

In Column 128, Line 19, delete "A-8," and insert --A_8,--.

In Column 128, Line 39, delete "A-8," and insert --A_8,--.

In Column 129, Line 67, delete "A-8," and insert --A_8,--.

In Column 130, Line 18, delete "AS8," and insert --A_8,--.

In Column 130, Line 25, delete "A-8," and insert --A_8,--.

In Column 130, Line 27, delete "A-8," and insert --A_8,--.

In Column 130, Line 50, delete "A-8," and insert --A_8,--.

In Column 131, Line 37, delete "A-8," and insert --A_8,--.

In Column 131, Line 54, delete "A-9," and insert --A_9,--.

In Column 132, Line 39, delete "DYNCII2," and insert --DYNC1I2,--.

In Column 133, Line 55, delete "A-9," and insert --A_9,--.

In Column 134, Lines 32-33, delete "XM 005637736.2," and insert --XM_005637736.2,--.

In Column 134, Line 36, delete "A-9," and insert --A_9,--.

In Column 135, Line 45, delete "PDSSB," and insert --PDS5B,--.

In Column 136, Line 29, delete "A-9," and insert --A_9,--.

In Column 136, Line 59, delete "ATI," and insert --ATL,--.

In Column 137, Line 54, delete "C_I0," and insert --C_10,--.

In Column 139, Line 23, delete "C-11," and insert --C_11,--.

In Column 139, Line 31, delete "C11," and insert --C_11,--.

In Column 140, Line 34, delete "LW" and insert --LW,--.

In Column 144, Line 47, delete "LURAPIL," and insert --LURAP1L,--.

In Column 146, Line 61, delete "C-7," and insert --C_7,--.

CERTIFICATE OF CORRECTION (continued)
U.S. Pat. No. 11,484,581 B2

In Column 147, Line 15, delete "C-7," and insert --C_7,--.

In Column 148, Line 39, delete "PDSSB," and insert --PDS5B,--.

In Column 149, Line 3, delete "COLSA1," and insert --COL5A1,--.

In Column 152, Line 51, delete "DOCKI," and insert --DOCK1,--.

In Column 155, Line 57, delete "C-7," and insert --C_7,--.

In Column 156, Line 2, delete "C-7," and insert --C_7,--.

In Column 156, Line 17, delete "C-7," and insert --C_7,--.

In Column 159, Line 58, delete "C-7," and insert --C_7,--.

In Column 161, Line 11, delete "XM 014119834.1," and insert --XM_014119834.1,--.

In Column 161, Line 28, delete "C-7," and insert --C_7,--.

In Column 162, Line 38, delete "C-7," and insert --C_7,--.

In Column 165, Line 24, delete "XM_U14116817.1," and insert --XM_014116817.1,--.

In Column 167, Line 30, delete "XM 543989.5," and insert --XM_543989.5,--.

In Column 168, Line 66, delete "C-7," and insert --C_7,--.

In Column 170, Line 30, delete "INPPSK," and insert --INPP5K,--.

In Column 171, Line 35, delete "Q VFA1T" and insert --QVFAIT--.

In Column 171, Line 38, delete "CSNKlE," and insert --CSNK1E,--.

In Column 171, Line 45, delete "ClW" and insert --CIW--.

In Column 173, Line 16, delete "UBE20," and insert --UBE2O,--.

In Column 173, Line 27, delete "C-7," and insert --C_7,--.

In Column 174, Line 54, delete "C-7," and insert --C_7,--.

In Column 177, Line 9, delete "L CLRI" and insert --LCLRI--.

In Column 178, Line 57, delete "C7," and insert --C_7,--.

CERTIFICATE OF CORRECTION (continued)
U.S. Pat. No. 11,484,581 B2

In Column 179, Line 5, delete "C-7," and insert --C_7,--.

In Column 179, Line 51, delete "C-7," and insert --C_7,--.

In Column 182, Line 2, delete "ClE" and insert --CIE--.

In Column 183, Line 64, delete "C-7," and insert --C_7,--.

In Column 184, Line 54, delete "LlL" and insert --LLL--.

In Column 185, Line 17, delete "C-7," and insert --C_7,--.

In Column 196, Line 24, delete "NPEPlL," and insert --NPEPL1,--.

In Column 196, Line 67, delete "C-7," and insert --C_7,--.

In Column 198, Line 4, delete "ARIDIB," and insert --ARID1B,--.

In Column 204, Line 20, delete "UBE2O," and insert --UBE2O,--.

In Column 204, Line 38, delete "C-7," and insert --C_7,--.

In Column 206, Line 34, delete "IN080," and insert --INO80,--.

In Column 209, Line 34, delete "CACNAiS," and insert --CACNA1S,--.

In Column 209, Line 60, delete "P01D1," and insert --POLD1,--.

In Column 210, Line 3, delete "C-7," and insert --C_7,--.

In Column 211, Line 20, delete "C-7," and insert --C_7,--.

In Column 212, Line 44, delete "FAT 1," and insert --FAT1,--.

In Column 213, Line 23, delete "C-7," and insert --C_7,--.

In Column 213, Line 52, delete "C-7," and insert --C_7,--.

In Column 218, Line 57, delete "C-7," and insert --C_7,--.

In Column 221, Line 12, delete "C-8," and insert --C_8,--.

In Column 221, Line 57, delete "KISSIR," and insert --KISS1R,--.

In Column 222, Line 25, delete "C-8," and insert --C_8,--.

CERTIFICATE OF CORRECTION (continued)
U.S. Pat. No. 11,484,581 B2

In Column 223, Line 21, delete "C-8," and insert --C_8,--.

In Column 223, Line 57, delete "QT" and insert --QT,--.

In Column 223, Line 59, delete "C-8," and insert --C_8,--.

In Column 224, Line 52, delete "C-8," and insert --C_8,--.

In Column 226, Line 38, delete "ARHGEFI1," and insert --ARHGEF11,--.

In Column 226, Line 52, delete "ClH" and insert --CLH--.

In Column 229, Line 47, delete "IFF01," and insert --IFFO1,--.

In Column 229, Line 60, delete "KISSIR," and insert --KISS1R,--.

In Column 233, Line 6, delete "ARHGEFI1," and insert --ARHGEF11,--.

In Column 233, Line 7, delete "C-8," and insert --C_8,--.

In Column 240, Line 46, delete "C-9," and insert --C_9,--.

In Column 241, Line 63, delete "G-10," and insert --G_10,--.

In Column 243, Line 15, delete "G-15," and insert --G_15,--.

In Column 243, Line 25, delete "G-7," and insert --G_7,--.

In Column 244, Line 20, delete "IFF01," and insert --IFFO1,--.

In Column 248, Line 27, delete "YCl" and insert --YCL--.

In Column 253, Line 39, delete "G-7," and insert --G_7,--.

In Column 254, Line 1, delete "CT" and insert --CT,--.

In Column 255, Line 9, delete "CACNAIF," and insert --CACNA1F,--.

In Column 255, Line 27, delete "XM_14121983.1," and insert --XM_014121983.1,--.

In Column 256, Line 46, delete "G-7," and insert --G_7,--.

In Column 259, Line 28, delete "GLIl," and insert --GLI1,--.

In Column 262, Line 10, delete "G-7," and insert --G_7,--.

CERTIFICATE OF CORRECTION (continued)
U.S. Pat. No. 11,484,581 B2

In Column 262, Line 66, delete "G-7," and insert --G_7,--.

In Column 263, Line 64, delete "G-7," and insert --G_7,--.

In Column 265, Line 36, delete "HISTIH1T," and insert --HIST1H1T,--.

In Column 266, Line 57, delete "G-7," and insert --G_7,--.

In Column 267, Line 22, delete "LIH" and insert --LLH--.

In Column 268, Line 15 (Approx.), delete "G7," and insert --G_7,--.

In Column 268, Line 20, delete "G-7," and insert --G_7,--.

In Column 268, Lines 34-35, delete "XM 005624449.2," and insert --XM_005624449.2,--.

In Column 269, Line 27, delete "XM005640052.2," and insert --XM_005640052.2,--.

In Column 270, Line 17, delete "HISTIHiT," and insert --HIST1H1T,--.

In Column 270, Line 58, delete "LUC102151792," and insert --LOC102151792,--.

In Column 270, Line 63, delete "PlG" and insert --PLG--.

In Column 272, Line 29, delete "C18Hllorf84," and insert --C18H11orf84,--.

In Column 273, Line 23, delete "(SEQTDNO:8930);" and insert --(SEQIDNO:8930);--.

In Column 274, Line 30, delete "CI8Hllorf85," and insert --CI8H11orf85,--.

In Column 274, Line 66, delete "G-7," and insert --G_7,--.

In Column 276, Line 15, delete "TNKS IBP1," and insert --TNKS1BP1,--.

In Column 276, Line 32, delete "G-7," and insert --G_7,--.

In Column 276, Line 51, delete "G-7," and insert --G_7,--.

In Column 278, Line 30, delete "MYOSA," and insert --MYO5A,--.

In Column 279, Line 29, delete "FAMIO1B," and insert --FAMl0lB,--.

In Column 280, Line 19, delete "AR" and insert --AR,--.

In Column 280, Line 36, delete "XM 014114498.1," and insert --XM_014114498.1,--.

CERTIFICATE OF CORRECTION (continued)
U.S. Pat. No. 11,484,581 B2

In Column 281, Line 7, delete "G-8," and insert --G_8,--.

In Column 281, Line 17, delete "MYOSA," and insert --MYO5A,--.

In Column 281, Line 56, delete "INSIGI," and insert --INSIG1,--.

In Column 281, Line 56, delete "G-8," and insert --G_8,--.

In Column 284, Line 62, delete "G-8," and insert --G_8,--.

In Column 286, Line 7, delete "ATP7B1," and insert --ATP7B,--.

In Column 286, Line 7, delete "G_9." and insert --G_9,--.

In Column 288, Line 46, delete "(SEQ1DNO:9465);" and insert --(SEQIDNO:9465);--.

In Column 288, Line 49, delete "T-7," and insert --T_7,--.

In Column 289, Line 22, delete "T-7," and insert --T_7,--.

In Column 290, Line 44, delete "Del." and insert --Del,--.

In Column 293, Line 66, delete "GLIPRiL1," and insert --GLIPR1L1,--.

In Column 295, Line 39, delete "D102," and insert --DIO2,--.

In Column 296, Line 16, delete "SERPINGI," and insert --SERPING1,--.

In Column 298, Line 20, delete "NIIH" and insert --NIIII--.

In Column 301, Line 38, delete "OR16A12," and insert --OR16Al2,--.

In Column 302, Line 53, delete "CHG" and insert --CIIG--.

In Column 304, Line 10, delete "T-7," and insert --T_7,--.

In Column 306, Line 45, delete "PlG" and insert --PLG--.

In Column 308, Line 21, delete "TJ7," and insert --T_7,--.

In Column 310, Line 48, delete "OR10A12," and insert --OR10Al2,--.

In Column 311, Line 30, delete "HIATLi," and insert --HIATL1,--.

In Column 312, Line 19, delete "(SEQIDNO: 10396);" and insert --(SEQIDNO:10396);--.

CERTIFICATE OF CORRECTION (continued)
U.S. Pat. No. 11,484,581 B2

In Column 312, Line 28, delete "ARFIPi," and insert --ARFIP1,--.

In Column 312, Line 60, delete "OR10A12," and insert --OR10Al2,--.

In Column 316, Line 4, delete "LUC100856036," and insert --LOC100856036,--.

In Column 319, Line 3, delete "T-9," and insert --T_9,--.

In Column 321, Line 22, delete "171B)." and insert --17B).--.

In Column 321, Line 54, delete "1D8" and insert --ID8--.

In the Claims

In Column 323, Claim 1, Line 47, delete "comprising" and insert --comprises--.

In Column 324, Claim 4, Line 5, delete "manlmary" and insert --mammary--.

In Column 324, Claim 8, Line 55, delete "Thl 7" and insert --Th17--.

In Column 324, Claim 10, Lines 62-63, delete "plasm on" and insert --plasmon--.

In Column 325, Claim 15, Line 28, delete "InterferonGamma," and insert --Interferon Gamma,--.

In Column 326, Claim 15, Line 5, delete "XtendIII," and insert --Xtend III,--.